United States Patent 10,662,479 (IMMUNOGLOBULIN EXPRESSION LEVELS AS BIOMARKER FOR PROTEASOME INHIBITOR RESPONSE) - sequence listing, part 13

SEQ ID NO: 828 - DNA, 99804 bp, Homo sapiens
atggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttgatgtttattaaggttttttttttttttttttttttttttttttttactttctggtaaaattcacctagtctcaatcaaggcctatatatcataaggctttgttatgattagctttgcagaaccttgtagtttatagtgttgttgagtacaatattgacaattcctaagacagacttccatacagaagtgcctgtcaatttatatttcctcctgggtggtcacatattgaaactccagccccttaagcaaccctcttgttctgaaggcaggtctggtaagaataggtaagtatcagaaagaaatcacctctggaaacacaacccaaatccaagaatactcaatgcagttcttcccaaggagaagggcaataggcctttttcaaactacattttatatatttttcaatctatactttgtggtgatagttgcagttgaatatactaagtttttcattaatattgaattaacaatttatttataacaatgtatgcttagatttttccagccctatttataactgataacactgcagtatcctttttgcatacaattctctaatttcacactgctatgtggaagatatagcattttaatttaactttcattgctcaatagggatcctgaggaggctatagagggtgaaattaagaatatttgggattctgcttttgtcttttttgttaaattttctagtgactaaggctgaaagtaaatatgggttgggaagacagataaatttgtacatgttcccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggttttttttttaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagttatgaccaagtggaaatatatttcctgatgtaaaaggaatcactgaggaaaaagattaaaatattttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagtttaaattaaatgcctcagtcttcctactattcaaagacattttaaagcaaactacatgggtaatctccggtgacatttttatgaagtaaaatacctttcggttaaaaatataaaatacaggtatatttttacggcatggtattttaattgaaaccctgatgctactcaatttttctcaagtatttcatcttcatttactcaataaaggaaccttgtaagaattatagttaggcatcctacctgatgattttatcgggaccgtattatttccacttccagaaatgtcgttcctttcagtcggttaaaatcaattggaaccaactacaacctacaagttttcagctccagtaatattttgaaaactttttaaaaattaagcaagcccttttaataattactcctttcgcaggtgttcttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccattatttgctattactgctaatgttcaaattttgatcctgttgatttaatagcatgctccctctagctctccttctcatctatctatctatacacatgcacacacacttatacacgtaagcttttctctgagcaattttattttgattcttggtggctggtaatatgcttagatcctgttgactatttcaactttgtctcatttcttcatcctatcaacacagacatattgactggcttttaactactggatttccttgggagataaaatttagatcacattttttcttaagctctagatgtcttttccattactatggtgaagttacattgactgttctgaggaaataattgaattattgaactggtattatttccttttattcttttactttggtgtctgtgtttgtatgtatggaaggttttttaatgtagtaaatccatatatagaaataacttgattttgattcagtgcttctcaaaaacctattttcaaatgtgctaaagatgtctacagatttattcaaatagagtagtttgtgaatatataaatagattgaaggtatttggactttaattaaactgatttagctagtatccttctggctatttttttgttcattttcagtgtagttgggagtcatagattccttctttctttctttataaggtcattcttatggcaaatagtacattcagttcttttattcagaccaacttgttattgaagcttgatagttgcctgacatacatgttatctgaagcaatgtctaggaaagccaaatgaggaaaggagacttatctagggtttttgatcacaggaatcatttccataatcaattcagtcaacactctcacatcacttctaggtatttgccccaaattacttggatatttatgttccctttcaagtttagttttctcatttaggaatttaccttatgtcattagttgtaaactgactatctagggctcggacaaaaataatttcaactgtaggaaaggcaagtcttccaacagatgcctacatttttcttgaagtcaagaaaaatgttcaggtattttgagcatctagggataggatttatacttgtggaattccaaactgagaaaaatgatgtaaggcattgtactttgactggaattagttaaataaaaaggatatgaggtatttggctgggaaaaggagattgttccatattataaaacctcatctaaactaacttcccaagatcgtggagaacaaaaaggaagggttggctttgaaatgtgatattaagagggttatgttgattcggaggtagtgataaagttctgttaaggtataacatatagtcccattaaatagaggataaaaataaaacaccatcacatttcatgttattaattcctatggcaacctactaggctatacctttatattctctttatgatgaaacatgaaacaataatccttttcagaaacctcttttataagtgataagaagggtttggctaactttattctgaatatgccctatatagctttcagtgctcctccagttttctctgataaaactaggaggaaaattatctgcacatcagattgaaaataatactgcatatcatttcatagtggtcaaaattttcccataccacttgatggggatgttttcccacaaggtttttgttctacaacaggagagaagactttgcctagttcttccaatatgtgcattgcttctgcttagaaaaaaacaaacttttaaattctctttgctgggttaatgactgttctatagattcccatctctaaggaatcttctttggtagtaaacactggaaaacagtcactacgaaaactcataaaatgtctagtttcctatacattagtccaacacatcagtctaattctgaatcccattgaattagcaaaggcttccggctgcagttttctaaatagactcagagccctgctgttggccaatgtgctgcaagaactggagcctgggatctaccaggacgatattctgttcagtcacagaagcaagtcggagagtggccaagacttgggctttctgctcctgcaaatctgattccatacggattggggtgccctcaaactgggagcattgagttttctatgtatggaagtaaatattttaaaagcactttgtgaaacattttctcttaacgtcggagactgcagcaacgcatgggaaggatgggaaacagggtgaagcagagaagcaggacccggcagtggcaagcactcttccctttcctgctgcctttgttctgcggggcaccctcggagcagatccgctactctattccagaagaaacggtccagggctccgtggtggggaaccttgcggaggacatgcggctgcatgttcaggatttattgacctgaaaccttagagttagtgcagagaaacaatactttaccgtgaacacggagaatgggaacatacttgtgagtgacagaatagatcgagagtcactgtcttcaaaatcctctgtgtcatacccttagagattgtagcagagaatcctctaaatgtttttcacataaatgtgatgatagaagatataaatgataacccacctcattttccccaaaatagcattgttttacaaatcaatgaactagcaattccaggcattcggtttggcctggaatctgctatagatgcagatgtagggcctcactctctccagagttaccagctcagttctaatgaacatttctctctgatgatggacaagactaaaggcaagaacgctccagaattagtgctggagaagcccctgggccaggagcaacagagctctcatctcctggtcctggaagcaatggacatgggtgacccagtcccaactggcactgctgcaattcaaattgaggtcactgatgccaacgataatgccccagtttttagccaggatgtatacaaagtcagccttagagagaatgtgcccccaggcacctctgtactaaaggtgacagccactgaccaggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgtaaaattatactagaaatcctagatgagaatgacaatgccccagacgtggtttttacttcagtgtccagttctgtaactgaggacgcagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccacgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgccgcgggtgctgtaccccgcgctggggcccgatggctccgcactcttcgatatagtgccacgcgccgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtgacagtcctgtgccctctgattcccaagcaaagctgcagatttacctggtcgtggccttggccttgatttctatgctcttcttcctcgcagtgattttggcggtcgccttgcacctgcgatgctcttccagcccctctgcctggggttgctttcaccctggtctctgttctaagactagaccaggggtttttcccaactacaatgagggaactttgctttattcctgcaatctgtatgttccctcggattctagaaaaagaagatttaattttctcaccatgacaccagaaacagtccccccacaagatctttctaatgaagtttctctggtagcaagcttcactgaagagaataacaagataagctctaactctgttgctcctactcacgtgagttccaatgaatgtctttcatttacaaatggatgaggtttaattttcaaaccaatattttggcaagaaaatcttaaacatattatatctactattgcttcaggtttgtttgcccactcttaatatttcctgttcctttctgtgtgggccagtaacttcattattagctttcatgtatttttgaaacattttcaccatttttacgggagactttttttttttttggacggagtctcgctctgtggtccaggctggagtgcagtggcatgatctcggctcactgcaagctctgccttccgggttctggccattctcccgcctcagcctcccgggtagctgggactacaggcgcccgccaccacgcccggctaattttttgcatttttagtacagacggggtttcaccgtgttagccaggatggtctcgatttcctgacctcgtgatctgcccgcctcggcctcccaaagtgctgggattataggcgtgagccactgcacccggcccggagacattgtttatacacacacacacacacacacacacacacacacacacgtgtgaaaagtgggtattatgatactgctgtcattgagatattttaattgaggaataaatttttttcctgtgatgtttcttgggacatcaatatttgagtatataaggctttttctttaatccattaactataaattttgaagaaaatgcatgagaaaatggagaaaatgtgttttttttttaaaaaaaattgagattaaggtctcattatgttgcccaggctggactcaaactcttgggctacagtaatcctcccacctcaatctccagagtagctgagactacagttgcctgaaactgtgcctggcagagaaaaaagcttaaaaaaataagaacatggtaatgatttgataatattcagttacatttacttttgattcttgtaattcaagtaaactcaattttatgtctgatattttctcacagctacctatatatttcttcccaatttaaaatatattattttattttatgcctagcaaatatctttacagtataaatatttacgctcatgaaagtacgtagccagttatttcttagggagaattttttccctatattttgatgggcttccaaaagtattaccagtaattctcagtaattacaattaggtcagttacccaggaaaaggtaagtctgtaacattctttggactaccaattttcttttactaagtttcctgaacaataaatatttttgaaatataatgtattaatagaattctggagtacttccattatttccagtcaatgcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgtacagacaggagtctcactatgttgagcaggctgatctgaaacttgggctcaggctagcctcctgcttctccctcccaaactgctgggattacaggcgtgaaccacagtgccccgcccttatcagatattcttttctggctgggcgcggtggctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctcaaaaaaaaaaaaaaaaaactttatcctctagtttcatccattgatgacacttgctttaatcacttattacaatcacctccaaatgaagattttataattccattgtttcttctacagttgttaattggctttctaccttgaagaagagttttatattctctatatatgtttgtttctatgattctggaagcatggttttctattttattcaatggcctgtaatctgttaatatcaattatttattttgatgctgaaattgtcccaggattggcctttgggactccctttaggctgatttctatgtcctttctgttacagcaagcttgggattatatccaagatttgtaattccaatgtacttacttctgtcagtgtaaacaaagtacgatttctggactagatgacttgggcattgtgggggaggtggaaattagaggtattctctgtttttcctgtaggatcttgcatttcttcctcttgctgcttgtctctttgtgtcgggaacaggccccccaaaatctggccataaactggccccaaaactggccataaacaaaatctctgcagcactgtgacatgttcatgatggccgtaatgcccatgctggaaggtagtgggtttaccggaatgagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacttctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctttcaaagttcagtaattctttctggccattagggatatgtccatttatactttctcagtatcccaagtcatttcatggttttaaatcattcatgaacttccaaatatagtgaatttatttcttctgcatttaaaattttatcacttaaatatacaatataccgtattgccatgacgaaaaatggtaaagactatttttcacttctgttatgcatttcattaatacgatatctgtatgtgtttccaagttagacatttcttttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgcagggaaacataacgtcccaattattttttctttcttctttgtttgctgcctatctactttgaaagatacaatagttaaaacccagaaaagagattggaaaccccttagagaatgaaagacatccaagggctctaaaatgcggcagttgctgcttctgagaccaaaaaagggggcaaaatatagagtgtgtggttctacttgtgtgattttttgaaagaaagtatttgaatttatctaaaaatactaaatttgtatttacattagttttcaaatagaatttaataagtacagtgttctataggtaatattgagagaaatagaggacaatgaaacctctctcctccatcatcttgtatgaactaccaaaatgtttatcatatggacagttctcatatatagtcaaatagaaagaaagacataataggaaaacaaatgacttgggaaactaagctaacatggtctaattattctgacctctgctcacctaacttgatttaggaacaaatcattgagagttagagcatgaatagtcaagactgttagaccatatctcaaatatcagtgacttcaatcaactatgtttccagtttaagctgaataggctttattaaatagttgttgaatgaatggataaacaaataatgtactctggggattacctgataccaggattctgaattttcagatgtatcatagaaggatagcagctttgcaattaggtaaattgttaactgtgtcacctttagcaagttatttaatctctttgagcttcagcaaagtaggaataatcatatctaatttgaaaggtcgtggtgatggctagggctaacaaaaatctgattcacaacatgcaattaattaacagtagccatttttagtggttgaccaaaaaaaggatttatattttcaatgccagcacactcgatgttctgttgggaaaaataataatgatttttgtgtgcttctccatatggtataatggaatgatttgtggatggaaataaaactgttctaaaatttttgtgacagctggtttaaaaatcttaagtgcctaggcacattcttgattgagaagccacagttttaggccataaaagatgggggaaagatttttatatgagacaattttgtgagtgttactttttctttgtctgaaccatagtgaaatctaaacaaggatcttgtgaaacttattttaaagaagcagtttacttcaatgggatcttagataatttcaccagaaaatggatcaccgaaaccagaaggctggtgatcattatttggtttgggccatataagaattgaaactaacggcttagctttaggatttttaggacacttgttgataatttaggattcataattaacatatgtgttgattgttttctgagactaactgggcaatgggtttggatgtgtttacatttattctgattccagtcataaaattatgtcaaggactttccttgtctttttatgtgtatgacagatgtgtatgtatccatttcatctaacaagttaaagcgttcagctataatttaaaatttgtagcttcactgttttatagtacctaaaattggaatgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctcttgatcttgggatgcacccaccccacctcagcctcccaaatagctgagattacaggtgtgagccaccatgcccgaccactttgagttcacttttaagaaaccatacttaatggaaaattaccagtaacagggcatactgtttaggatgcattcctaaaatattaatggcaaaagatagccagcctatggcaaagctaattggaaaaaatattttataaaggatgagacttctggataccatatgggaagggctctggttcaggaaaatgtttttaaaaaactgtcattgaagagaccatagaatcaaacaaaataatttaatctgtatgtaaaagaagttggtaccaccataatttttcttatacatgtcatataaggatctactctgtgtattgtcattgagggcagatataatttcttagttcatcattaactctctgaagtatttcacacagtagtttgtacaccttctaagtactcaatacaatgcttgagttcaattattggaaagtggtctcttggagaaaaaagaatcatagtgcaaaaccaattattttacatggacttttcctctatatctaagccctaataagaggcagctgtctgatatacatacatacatacatacatatatatatatatatatatatatatatatatatatatatatatacacacacacacacacatatatgtatatatatatttggagtaggggatggagtcttgctctgtcacccaggctggagtgcaagtggtgtgatctcagctcactgcaacctctgcctcctgggttcaagcgattctcctgcctcagcctctccagtagctgggattacaggcgcctgtcaccatgcccagctaattttttaaaatatttttagtagagacagagtttcatcaagttggccaggctgctcttgaactcctgacctcaggtgatccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaaaaaatccatatgtgaaaattcttagaagcttcctatacaatttcagctgaagattcagccaacagttcattctgagactgtgttccatggaaaaagtaaagcccaggcatggaagtgggaatggaaagaaagattctaagcctacaaatactcaaacatcaagaagaaataaaaataagtcatcacttcgacttcatgtgctaacatcactgaggttataaattcccaggaatattttattgcgggagcaagactgcactgctgcctttcagcttgcaaattccagtgagaaacgtctttctctctgctctcaactaactctacagaacgctgtcctctcatttcttcaggctgcagttctagagtagggactcagagtgccactgttggccagtctggaaacagagataaatgagccaatccccagacattccggcttggtggcttttctaatttcatggaatgcaaatccaagagcagacccacaacattcctattatggctcctagttctacaaattataagcaggaacggaacggatttacaggcaatgagttcagctccttcttggctggagattctataatccaagaagagtttgaaaaggggcttatttgggctggagcagcagcaactctaactgtggaaaaggtggggaatggtgctggactgacagtctgggtagaaccaaggcgactactgcctcctttcctgctatttctatcctgctgggcattctctatgatgcagatccgttattcagtcctagaggagctggccaagagtttggtggtgggaaaccttgccaaggatctgggactcagtgtcgaggacatgcccacttgaaagcttcgggttaatgctgaggaataatacttcattctaagtggggaaagtggagacttacttgtgaatgactgaatggatcaggagcagatacgccccccaattatagcttgggccataacgctttgaaatagttgaaggccaggcatggtggctcacacctgtaatcccagcactttgggaggccgaggcgagcagattacgaggtcaggagttcgagaccagcctgaccaacatagtgaaaccctgtctctactaaaaatacaaaaattactgggcatggtggtgcaggcctataatcctagctactcggggggccgaggcaggagaatcgcttgaacccgagaggcaatcgcaccactgcactccagcctgggtgacagagcaaggcgccatctcaaaaaaaatgaacaaacggtagttgaaaattctttaaatgtttttcacattaatatggagattcaggatatgaagaatcatgcaccacggttcagcaggaatgttattaagttacgtatctctgagtttacccagctggaacaagatttgcaacagaacctgcagaagatcctgatgttgagagaaattccttacaaaattatcaccttagcagcaactctatatttctctttgaagtaaaagtgaccaacagtggaaagacatatgttgatcctgtgttagagaagctgcttgactaggaaaagcagagctcccatcccttagtgctagcagccttagacggccccccaacaaagcagcatcactcaactcctgatcctattggttgaagccaatgacaaccctgtgttcatctaggatgtgtacagcgtcggccttcaggaagatgtgcatccgggcactcctgtgctgagagtgagggccaccaaccaggactagagtgtcaaggcagagatcacatatggcttcacaacccagagtacccatatctagtttggccttgatcaaatagtggagaaatgaaaactttaagtacattggacttttaaagatttttaatttccatggttttggtagcaagtgacagagagggactcattgtccagtgtacagttgagaccgaatttctagaagataatgacaatatcctagaggcgatttttacttctaattccacaatgattcccaaagattctgcaccttggacagtaatcactgtccaggatttaaatcacaagatctttaaatcacaagatctggattcgggagaaaacgaggtcacatgtctgatataagaaaatgcaccttgagaaaaatcttcctccaataattaactacatgcttgtaacaaatggggccgtggaccaggaacagacccaaggtataacatcagcatcactgccactgacagaggcaaaccaaccctctcgtccagcccaagcatcaccctactcattggcgatgccaacgacaatgctctggttttctaccaggcctcctacgtcgtccacgtggccaagaacaatcttcccaaagcctccatagtgtgcaagtagacacctccaacctagacttgggacccaacagccaagttccctattccatcgtggccagtgacctggagccacaggcgctgtgattctaggtgtccttgagcgcacagtgcgccttcgaccaagagcagccgcgagccttcaagctcacgctgcaggcccgcgaccaggactagctcgcgctcggcgtcaacgtgagcctgcgcgtgttggtggacgacctgaatgacaacgcaccgcgggtgctgtaccccagctctggagcgcaatggcttcgcgctcttggatatggtgctgcacgccgcggagcctggctacctggtcaccaaggtggtggctgtagacgcagatgtgagacacaatgcgtggctgtcctaccacgtgctgcaggccagcaagcccaggctcttcagcctggaatgcgcaccgacgaggtgctgacagctcgcacgatgggccacaggaaagcgactcgccagcgcctactggtcgcggtgcactgcggtggacagccgctcctctcgctaccgccacgtcaccaccactaccgcccctcgtcgccgacagcctgcaggagactctgccagacctcagcgatcactctgcaaagctacagcctgaatccaaaattaatttatatctggtgattgccttagctttaatttcctttttattcttcctgattgcattgtttgtgctggttttaaagtgccgaagaccccaaaatgatcctgtctgagtctttcccacggatgtctatcccgcgctaagccccaggtttctgggtaactgtagctctatgatgccatattcctaccaggtgtgtgcttctcctacgaatccagggctgagtgaacttcttttttgaatccctacccctcaggactcaatagcagtttcactgcagaaagccccttggggaaggggatgattgtgattattctaattgcttgggcagaatccactctccaaggtgaaaaattcttgatgaaactaagttcagtcacaagcaggttttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaaaaacaaaaattaacaaggtttagtggtccatgcctgtggtctcagctacttgggaggctgaggtgtgaggatcacctgagtctggggagattgaagctgcagtgagctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaaatcagataatttggcatcttcaatctagattctgatgctcacctgaaaagtctgctaaggattggaaaccaagaaaagtgaagtatctcaacagatatgtgtcacttgtgtgtactggattttttttttttttttttttttttttttttttttttgagatggagtttcactcttgttgcccaggctggagtgcaatggcatgctctcggctcactgcaacctccgcctcccaggttcaagtgattctcctgcctcagcctccctagtagctaggattacaggcatgtgccaccacgcccagctaattttgtatttttagtagagacggggtttctccatgttggtcaggctagtcttgaactcccaacctcaggtgatcttccctccttggcctcccaaagtgctgggattacaggcatgagtcactgcgcccggtcgcgtactggatttatattgtgtaatactttgctctagcagtatagtaggtgagacagtgactgtgtctagtgagcaaaaggcacttatttgacacttttgactcttcctttctacttaccttatttaaaattgatttttgcatgtggcatgatgcaccagttcattgaggtaggggttgaagttatttcccatttttttcaataccatttattaaaaatattttcctctttctgttgaatttgcttggtgcctttgttgaaagtcatttcactgatatatgtagttctatttctatattcttgatcatgtttcatttgtctattcttttactaatagcacactgtctcaattattgtagctttatagtaagtcttgctacaaagtcttactacaggacaaagcttgtaggatttttgaatgggatggcattgcatctatacctttatcagggaaagagggaaggagggaggaggatcatcttaacaatattgacacttcaaatccatgaacatggtatatatttccatttaattaggtctttaatttctctcagctatgttgtatagttttcagtgtagagaggtcatgtatatttctcattaaattgtccctacatatttgatgttttctaatgttattgtaaatagtatttttaaaattgtatcttctaattgttcatttctagtttacagaaaaatgaaaaactatgtttttatgtattctatatgcttttgaaaagtaagaggtgcaaagtgctctattcttacactatattgtgtgagaatataagtcgaaaccactctgcataagttcaggcttccattctcttcagtttgtaggttgagagaacccatccagaaacagtaaacattggtgtctgcccaagtctggtcctgggtggttcattcattcatttacataacaaatatttattaactgtctgctatatgcaaggcactgacctatggactaaggatgcagcaatgaacaaggcatatatgattcctgagttaatgggccctattctaatacatgatattttacaggtctgataaaagccaacaaggagaaatacaaaagcactaagagaaagcttatagtagggaagcttcgcctaatctgaaggtcaaggaaggctttctttttttcggaaagtgatatttagagagatgaatagattaataggatgagtagaagttatctaggtaacaaggaaagtaaaaaagaaattgtcaggcagaggaaatagcatgtgtaaagatctttttaaaaaataaaaggtgtgactcaagcaatttaaaagggctagggaggctagaaacagaaaataaatagatgaaactaataaggcagggagagccttgtaaatcacacttaaaattctggattttgttctaaatacccttgtacttaggagctattaaaatattttaaacaaggcagtgacaagatatttgaattattaagcttactctggctgctatatggagaattgatttatgagggttataaatagaaataggaagataagataggagactatggcaatattcctggtaagaaatggaagaagagctggcttggattaaaggggaggcagtggatgtagaaataaatggatgaattatagatatatttaggaaatgggttcaataagacttaataatggaataggtggaatataaatttcatgagggcagggggtgttttgtttattattatattcctaggtgtctgaaaatattgttgtgttgcctggcaagtggtagatcttcagtgaaatattattaactgaataaatacaatggataaatggggagcagggattaagagtgattcctgggtttccacattaaggaactggatggacaaagctaccatttgatgagaatggaagactaaagaatgatagatttaagagaaatcgagttgagttccagccatgttcatttgaaggatctgagaaacagtgcagatattcagtgtgtgattagacatatggtcatcattcttttttttttttgagatggagtctcgctctgtcacccaggctggagtgcagtggccctatctctgctcactgcaatctctgcctcccaggttcaagtgattcttctgcctcagcctcctgagtagctgggactacaggcgtgcaccaccacgcctggctaatttttgtatttttagtacaagacagcatttcaccatattggccaggctggtctcgaactctgatctgcccgcctcggcctcccaaagtgtggggattacaggcgtgagccaccgcgcccagccggttaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcagactagtcctagtgttcagttttgttttgttttttttctgtgtctggaattctattaaaatgtgtcaggctgttttaatttttgttgtttaattttctttcacatgattatatgtgctccatggatttttttgtttgtttgttttttgtttttgtttttgtttaagcggggtcttgctcttgtcgcgcaggctggagtgcaatggcttgatctcggctcactgcaacctccgcctcccgggttcaagtgattcttctgtctcagcctcccaagtagctgggactacaggcacatgccaccacacccggctaatttttgtatttttagtagagacgggtttcatcatattggtcaggctggtctcaaactcctgaccctggtgatctgcccacctcggcctcccaaagtgctgggattacaggcgtgagccaccgcacccggaggaaatttttaacctcagtttttcttcaccatctgtaaaactgcatagaaggaatgtttaggataaaagatgcataacaatcataacaaaattgttgggttttaatgttatgagtacacttggaggattctatgtccacacataccttaaacatcctatagagtccttagcattttaaagttgaaaccaacagtatgaatgatggtagaattttcccccccaggaagttagaactgttccatatcttgatagagggatgggttataaggatgtacacattttccaaaactcattgaacttaagagtcttgcatgtgactgtatataaattatactttaattgaaaataaatttaagaaaataaaattggctgggcgtggtggctcacgcctgtaatcccagtgctttgggaggccgaggtgggtgaatcatctgaggtcaggagttcgagaccagcctggccaacatggtgaaactctgtctccactaaaaatacaaaaattagctgggcatggtggcggacacctataatcccagctactcgggaggctgaggcatgagaatcgcttgaacccaggaggtggaggttgcagtgagccaagatcatgccattgctctccagcctgggcaacatgaacgaaatgccatcttaaaaaaaaaaaattaaaagaaaagaaaattagcctcccccaccctcactatacctcagactcacccctgaaagatcactactattcatccctggttatgtacacttacaaacattttctgtgtgtatgcgaatgtatgtgtggggttttctttgcacaacaggatcattttacagtatatatactgttgtgcaacttgctctttccacttaatatctcaaggaatcttttctttgaatctttatagccatgtacctcaatcttagtagttttctttattttatttttgaataggaaatacatttacatggttttaaaaatcaaaacaatatactatgtatatattgagaagtctgacttccatccctatcctactcctattccacccttgcttcctcctgtcccctgtaggtaaacattttataactttattaagcatcctgtcagcatttcttatgcaaatatgtacatatatttttatttccccattttttttacaaaaagataaaatactatacaccactttatatcttcctttcttcacattatatcctttaaaaatatttccatattggccgggcgcggtggctcacgcctgtaatcgcagcactttgggaggccgaggcgggaggatcacgaggtcaggagatcgagaccatcctggctaacacggtgaaaccccgtctgtactaaaaatacaaaaaaaaaaattagccaggcgtgatggcgggcgcctgtagtcccagctactctggaggctgaggcaggagaatggcgtgaacctgggaggcggagcttgcagtgagccgagatcgtgccactgcactccagcctgggcgacagagcaagactgcaactcaaaaaaacaaacaaacaaacaaaaaagaacttccatattaatatatagaaagctgttttttttaacagttgcttagcattcctttggattattaaccagtctcataaatgagcgctattgaatagccctgtacctacatcagtttttacatatgcagtatatctttgggatgaattcccagaaatggaattgaaattgctgggtcaaagaggaaataggtgtaattttcttaggtattttcacaagaagtgttaattctaactttctgttttgaaatgatttcaaattttcaaaggagttgcaagaattgtacaaagaactgtatctccttcacccggatgcaccgggtgaattatatgtattatataattgtatctgtaggccaggtgcagtggctcactcctgtaatcccagcactttgggaggctgaggcaggtggattacttgaggccaggagttcaagaccagcctggccaacatgataaaactccatctctactaaaaatacaaaaattagccaggcctggtaccccatgcctaagggtgaggcatgagaaatgcttgaacctgggaggcggaggttgcagtgagccgagatcgcaccactgcactccagcctgggcgacagagcaagactctgtctcaaaaaaaaaaaaaaaaaaagtaaaaaagttttttaaaaagatgtatctatatatacatatttacatacacacccaagtgtgtatgtatatatgtttgtgtgtatgtacacaaacacattatttttatatgatatgatttttttatgacatgattatttttatgacatttgagagtaagttgtagaaattatgtttctttattcctaaatacctcattgtgtatttcctaacaaggacattcttttatataattaaattttaataataaaaatcagaaaatttaacatcaatgcaatataattatttagcctatagtccatatttaaattctaccataccttatagtatattttactatacctcatagtaattttttttagtccaaaatatcacacattgcatttagttgccatgtctcttttttttttttttttttgagacagggtctcactctttcgcccaggctggaatgcagtggtatgatcttggctcactgcaacctccgcctcccaggttcaaatgattctcctgccttagcctcctgagtagctgggactacaggcatgtgccaccacactcccaccacacccagctaatttttgtatttttagtagagacaaggtttcactatgttggccaggctagtcttgaactcctgacctcaagtgatctgcccacctcagctaagtgctgggattacaggcgtgagccaccatgtgtggcctagttgccatgtctctttaatctactttaatctgaaacagttcctcagccttgtttgtttatatgaaactgacatttgtaaagactagaagccatttgtcttgtataatgcctttaatttatatttgttttatgtttcctcgtgattttatatatagagtttgtttgtttgtttgtctgtttgtttgttttgagatggagtctcattcttgtcacccaggctggaatgcagtggcgcagtctcggctcactgcaacttctgcctcccaggttcaagcaattctcctgcctcagcctcctgagtagctgggattacagatgcctgccaccatgcctggctaatttttgtacttttagtagaaacggggttttgccatgttgcccaggatggtctccaactcctgacctcaggtgatccgcccgccttggcctcccaaagtgccgggattacaggcatgagccaccgtgcccggacctcatgattgtatttatttatttatttaatattattattattatttttttttttttgagatggggtcttgctctgtcacccaggctggtgtgcagtggtgcgatatcggctcactgcaaccgctgcctcccagattcaagcaattctcctacctcagcctcccaagtagctgggattacaggcatgtgccaccacacccggctaatttttttgtattttttttagtagagacgaggtttcaccatattggccaggctggtctcgaactcctgaccttgtgatccacccaccttgacctcccaaagtgttgggattacaggcgtgagccaccacacccagccttatgattgtatttagactagacatttttttggtagtatattatttagccattgctgtgtaacaaattatcccaaaacttagtggcttaaaagaagcatttattatctcataaattttgtggatcaggactgggtatagctttgctgagtgcctctgcctcaaagtcttacaaggcagcaattaaagtgtcacctaaggctattgtcttatctgaagggtcaacagaggatggatccgcttctaatctctctcacatagttaatggcaaaattaagttccttgtggattgttagactaagggttccagttccttgctggttgttagcttgaggtctacctcagttccttgccatgtggacctccatagggcaaccagcttctgttagagcaagtaaaggagagtgccagagagggcaaatgtgatgaaagccacaatctttttataaacctaattttgaaagtgacatacaaggctaggcatggtggctcaaacctgtaattccagcactctgagaggccaaggagggtggactgcttgagcccaggagttcaagaccagcctgggtaacatgacaaaaccctgcctctactaaaaatacaaaaattagctggtctggtggtgcatgcctatagtcccagctactcaggaggctgaggccagagaattgcttgaacccaggaggcggaggttacagtgagccgagatcacaccactccactccagcctaggccacagaatgaaaccctgtcaagaaagaaaggaaggaacaagggagggagggaggaaggaagggaggtagggaggcagggaaagaccgagaaagtgacataccatcatttttgctgtagtttgttcattagaagcaaaatcacttggtccagcccacactctggggagatgattttctaactccatttgtaataacttattctacttttattagttggcattatacagtaagaaagagctttcttttctcttcttatttattcatatatggctcatgtgttttttccaatgagttatattctattactaacattttttattttgacctcaaattgttttagatgttaccaataagaacctcttcaagctggttcttgtgtccttttgccataactctctcattttcttgaaccctttcttactttctgatataagaaaatattagagactcatactttccttgttccagttctgagatgaaccatttatccaaaagccttgcttcattttagtagggaatagtatttagaaactaagatctgggtgtgaggtatgctcactgctaatgggctgtcactgtttctaggccttgtcagcagacggagctaggaaaaacacacataaacacacccatatttatatttgtacacacactccctcaaaatcgtgagttcatattgatacctccagttctggttcttcctagccttccccctttccatctttgtatttttattttccaacagtaagaaccctggctcccagtgctatgaatatatttactcatttgctccatccactgcactccagcctaggccacagaatgaaaccctgtcaagaaagaaaggaaggaatgagggagggagggagagaggaagagagagaaggaagaaggaagggagggagggaaaactgagaaagtaacataccatcatttttgctgtagtttgttcataagaagcaaaatcacttggtccagcccacactctggggagatgattttctaactccatttgtaataatttattccacttttattagttggcattatacagtaagaaagagctgctgaagatttgcttgcaattggttgtctttaaactgagggtatattgtcaaagtactgtgctgaaaagttacctgtagtatagttatgtgattcattaaaataaagtttgtttctattatgtgcagttttagagttttgccacactctggttgattagtatattttctgttgcttttttgttttgttttgttttgttttgtttttgagatagggtctcgctatgtcacccaggctggagtccagtggtacaatcacagctcactgcagcctcaacctcgtgcacttaagcgatcctcccacctcagcctcccaaatagctggggctgcaagtgcacaccaccatgactggctaattttttaattatttatttatttatttatttattttagagatggggtctcactatgtttccccaggctgaccctgaactcctggggtcaagtgatcctcctgccttagcctccaagtgctggtattacaggcataagccaccacacctagcctagtattcttttttgaatatgtaaaacattaacataaagtcaaaactattaaaaaaaggtgtactcagaaaattgtcattcctcccctataccttctgcctcattcacaccacactctgtagataatcgatttcattagtttgtggtttatcctcactgtgtttctttttgcaaaacgcaaaaacaaaacctatacatatttatattttcttatgtcctcttctttcttacacaaaaggtaacacactatgtaggtagtcctggctttgaacagtttcactataaaaatatttgttactacagcttaaataacataagtctcctaaaaataattcaaattttagttaccatggtatattaactttgagtagttccataaaggacaaacttggctgctagcccttcagtccacagagcactttgaaaataacagatgagcaaaataatgtggccaatcacatgacttctttcaaagtatgtcagtgatcagtcactgtgtgcctataatttagttcatgcacagacagcaaagcatgtagttgtgttgccttccagtgataaacccacataacattttagaaaaatgtattaagaattggccagcaaagataaaagtgcagcaaagaaacaaaagtgataatgttttcagtgaaatttgaattgaacataaatggagttatagaagaaatagctgaccatgggaatgttcacactgctactttcaagaatctctagaagggcagctaaaggagcttagtgaaggtgaatttattgacatgaatgagaaaagtaattgtgatgaaaaggatgaagatgtcccagagaaagtaatgccagcaaaaacttcacattaaaggaactctcagatatttcaaagcattgaaacctccaagaataaataaaatgttggaagttgatccaaacttagaaaggagtatggcaacttgtcaagatgaagaaaaggtgcttattcctttttatttatttatttagagacagagtttcactcttgttgcccaggctggagtgcaatggcatgatctcagctcaccgcaacctccacctcctggattcaggcagttctcctgcctcagcctcccaagtagctgagattacaggcatgtgccaccacgcccggctaattttgtatttttagtagagacagggtttctccatgttggtcaggctggtctcgaacccccaacctcaggtgatctgcccacctcggcctcccaaaacactgggattacaggcatgagccaccatgctccacctgcttattccatattatatgttataggatgaaaagaggccaaactaatcttgacatgttttttacaaggaaataatcctccatggttctaatttttttttttttttttttttttttttttgagacagagtcgcgctctgtcacccaggctggagtgcagtggcacgatcttggctcactgctagcaccgcctcccgggttcacgccattctcctgcctcagcctcccgagtagctgggactacaggcgccggccaccacgcctggctaattttttaaaaaatatttttagtagagacggggtttcaccgtgttagccaggatggtctcgatctcctgacctcgtgatccgcccgcctcggcctcccaaagtgctgggattacaggcttgagccactgcgcccggtgggtctaatgttttaaattacactgtgttaaataaatattagtttgttggttttttttttagtttttttatttctctacaaatttacaaccaataagagtttttaatgctttgacaaaaaatgttaaaggtcatagtacaatcgcatttcttcccattgattattaacatcactttacatagtttcatcttgcattagcaattttgtgtgtgtgtttgtggttttaaggagcggagagtttaataggcaagaaggaagggagaagacagaaggaaggagctcccccttacagagacagagggagcggggctccaaaagaggaggtccccatctaccgcggataccagccaggtatatatgcagaggctggtggaggtgatgtctgatttgcatagggctcaggggattggtttgaccaggcatatcattcacgtagcccgagaaaaagctggccctcccaccccagccttttaatatgcaaacgtagggcgccatggatgttctaaacacgtggagatatgtggggggcagccatgtggccaggaacttgtggggcaagggcaagaaggctgtgggaatcgccaagttgaatggacctagtttctaatggcctgcatttgcatatcaaaggttgctggcctggctcctagagccggggctttaaaagaaacttttccggagatgctttaaaaaatgaaaacttcccaaggaccccttttcctgtctatctgcataaaataatttcttttattatttatttatttatttatttatttatttatttatttatttatttatttattttgagacggagtctcgctctgtcgcccaggctggagtgcagtggcgcgatctcagctcactgcaagctccgcctctcgggttcatgccattctcctgcctcagcctcccgagtagctgggactacaggcgcccaccaccacgtccggctaattttttgtattttcagtagagacgggatttcaccgtgttagccaggatggtctccatctcctgacctcctgatccgcccgcctcggcctcctaaagtgctgggattacagaataatttcttaataactcctaccacattcctccctgtggcgatatcaaactaactgctgttaggaggctttgggcgaccattgcttctggctacttcctgctgaaaaggggcgtctaatggagaacagcagctagggctcctcctggggttgatctaagggtcctcggaagaatggcgtccatgtgtggttcagtttacagcaccgtttggagtttgattgcttctaggcgagaagaaacaattcaagttatagtattgagtatacagagtccaaatatcaatacaagacatataagcaagagagtgcttaataaaggggttaaccaattccataaagaagactggaagtaattaaagagggattgtagccactcggggctgaagcccacattttccctgagcctgtcaataattttgatttgatttttaagtccctgtagatttgcctcttctttactacaggtgttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcaccactgcactccagcctgggcaacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccctattgcaaatagtagagtgaggaaagcagttcccacaaatgtggtgtggtaggtaatttccatctaaaattttacttgccaacatatagaattcccctctgtgggcctacgaagttccttggttttattttcccaaacaaagaaacctccgggttacaggtaccttacttactttcattacctggcacaatttgcaaaataattgcccagaactagcatattgattcacattttcacattacccatccctttttcccccccaccaagctgcagaagatcaccacttgattcacaggaataagcagggccagggttagtctaaaatgtaggcaaaaagcttaaaaacaattaatgagactagggtttaatgacaaatgtatgataagctttggagcaaaatttttctctccagtcctcatttttggtaaaaactaattatgaatgaactttaatcttatacttggcctgattatttgcatgaagtgcagcaagaatggttatttctacataggacttttggattggctttgatgaaacactgttccacaaggaatttcagattagacttttaaagctgagcccagacatgggtttgtatcctctaatacctgtgagttgggttatcctctcctcttgaggtcccaagataaactcagagcttccagacctgttagaaagtgacattcttcactgaccacaggttaggaaccctgtgtggggactgtgtagacaaggtgtgaggccagttctccccaaggggcttttattggctctgcatgtcaagcttgattccttaaagggaaacacaccctttcagttaaagccttggcaaaataaccggtttttccaattgtgttctgttgacaaagaaaaatggattcttgctgcactgatgcgaacaactatattgccgtaagttaagagtacttacagatagtctccaaattttagaggaaccaggcagagaaaaatgaacatgctccaaattttgttcacagtagtataccttacttgattattaaaggccataaatagtttaaaataagtttcctttcccagtccatgcaccaaaatgatacggctctgatgagtggaggaacaacagggttcctggtcctcatgctggtttagataaaatgacacagacacatgtggagtggttttaaggagtggagagtttaataagcaagaaggaagggagaagagagaaggaagacgctcccccttgcagagacggagcgggggttccaaagctgaaagaggaggtcccccacattaacaatttttaaaataccgtacaactgcagaaaatgaggactgcctgtacatactgtttgacactttgtttttttttttaacttatcaactttattttgtttgtttgttttggttttgggtttttgtttgtttgtttgttttggagacgagtctcactctgtcagccaggctggagtgcagtggcacaatcccagctcactgcaacctccacctctcgggttcaagcaattctactgcctcagcctcccgagtagctgggattacaggtattcgccaccacatccagctattggttttggtttttgagacagggtcttgctgtgtcacacaggctggagtgcagtggtgtgatctcagctcactgcaacctctgcctcccaggctcaagtgatcctcccacctcagccttccaagtagctgggactacaggcatgcacaccatgcgcagctaattttttctattttttgtggagacggggtctcactatgttgcttaggttggtcacaaattcacagcctcaagcagtcctcctgcctcaccctcccaaagtgctgggattacaggcatgagccaccacatccagccttaccagctatattgaagtataatttatataacataaaatttgccttttaaaattatacagtgcaatgcattttgacaattgtttacatctgtgtaaccaccatgcaatcaaaatatagaacatttctataaccttcaaaagttccctcatgcccctttgcaatcaattcactacttctccagctccaggcaacaactggtctgcttcctgtcactataaattagtgttgcctctttcagaatttcatctaaatggaatcctataacatatactattttgtatccatcttcttttactccaaagttcttgaaattcattcatgttcctgtgtgtatcagcagcgtgttccatttgattgttgagcagtattgcattgtgtggatatatcacaatgtgttcattcattcaactgttggtggacatttgagttgtgtccagtttagtgctattctgaattaaagtgatgtgaacaatcatgtacaagtatttttgtaggcatattttttttatttctcttggataaataccccaaaacagaattgttttgggggtcatatgaaatgggaagtatatgcttaactttataagaagctgccaaactatttttcaaaatggtaatatcactttacattttcatgagcaatgcataaagcgttccgcttgctacattttctcaccaatgcttcctattgtcaattttttaaattttagcaattctagtgggtgtgtgatactatctcattgaagtttcaactgtttttccctgttgactagagacactgagcaacttttcatgtgttgtctatttgtatatcttcttgaagcattcgttcatctttaactgagctgaacgccttcttaaaattgagctatgggagttttaaaatatatccttgtagctgggcgtgatggcaggtgcctgtaatcccagctactcaggaggctgagacaggagaatcgcttgaacccaggaggcggaggttgcagtgagccgagactgcaccactgcactccagcctgggcaacagagtgagacttcatctaaaaaataataattatacatgtaattatatatgatttttatatatgtaatatatatattcttgatgtgagctctttgtcacatacatattttgtggatattttatcccagactatgacttgtcttttcattttcttagttgtgtcttttgaagagcagaagatgtaattttgataaagcccaatttattttttcttttatagtttgtatttcttatgtcctattcaaaaactccttgcctactgaaaacttatgatgattttctcctatattttcttttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggatagatagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccacatccacaccaacatctattgttttttgactttttaataatggccattcttgcaggaccaaggtggtagctcgttgtggttttaatttgcattttcctgatgattagcgatgttgagcattttttcatatgtttgtgggccatttgtataccttcttttgagaaatggctatttgtgtcctttgcctactttttaatgggattgtgttttatttttcttggtgatttgttagttccttgtagattctggatactagtcctttgtcagatgtgtactttgcaaagataatattttggatgttatatttccattataatttagttcaaagtattttctaatacaccttgcaatttcttctttgacccatggattattttaaagtttgttattttgtttgtttattttgagacagagtttcactttttttgcccaggctggagtgcagtggcacaatcccggctcccagattcaagcgattctcctgcctcagcctcccaagtagctgggattacaggtgcccaccaccacacccagctaatttttttttcttttttttttgagacagagttttgctcttgttgcccaggctggagtgcaatggcacgatctcggctcactgcaacctctgcctcctgggttccagcaattctcctgcctcaacctcctgagtagctgggattccaggcatatgccaccacgccaggctaattttgtatttttaatagagacggggtttcttcatgttggtcaggcgggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgaccagcctaaagtgtattgtttagtcaccaaatatgtaagtattacccaaatatatttgtcactgatttctaatttaattgtattgtgatccaaaaatatacattgtatagtttctattcttttaaattcgttaacatttcttttatggcacagaatatggtctatcttggtgagtgttgcttacacacaactgtgtaactgaaaactgtgtattctgcttctcgtggttgttgtatcctataattgtcaactagatcaagttagtaagagtgttgttcagtgatcttttcttcttcagtgtttactgtatttgctaatcccatccagtgaagtttccatttcatatattgtatttttcacttttagaagttccatttgactctttcatttccatcctcaattatcttcatatttttctttaaatttttgagcacatttataatggaggttttaaagtccttgtctgctaattttgtcacctctgtaattcctatgatgattttcttcctggcttggggtcataatttgttgcttatttgcatgtctaataatgtttttattggacagcagacattgtaaatgttatatttttgagtgtttggattttgtctttctttaagaactattgcagtttgttttggaaggctattatgttttttgcagatcaggttgatcttttcaaggcttgtttttaagctttgttaggacaggtctgtagtaacttttgccttgggctaatttagacctaccacttaattctgacttttttgattaatctgagtgttcagcagggtctctttattatggctaaatgaaattcaaacattttccagccctatgtgaccatcaagaattcagctaatagctccctggcagttcttcgcccagctgcagaaaagtgtcagtgcactctatgtatgctcagattattatttagccaaagacttggggatccatattaatattcctggagttctttgtgtagctccattctctttagtactctatcccataaattctggctgcctcaatctcctaatctccccaaactctaatatctattcctcaactcagcaaaaccatggtgttattcttggatttcccctttcctgccccacagtctgaaagttgtctccaggcaaaaaaaatggagatcctagtttgcggatcctcatttccttctccttttttttttttttttttttttttttttgagatggagtctcgctctgtcacccaggctggagtgacgtggcgtgatctcggcttactagaaactccggctcccgggttcatgccattctcctgcctcagcctcccgagtagctgggactacaggtgcctgccaccatgcccggctaattttttgtattttgtttagtagagacggggtttcaccgtgttagccaggatggtctggatgacctcgtgatctgctcacctcggcctccaaaagtgctgggattacaggcatgagccaccgcgcccggcctgcttctcttctcttatgggttagaatcctgcactgtcttttgaacaaatgtctaaaagcttttatcacacattttgatccacttcccagttgttatagtggtatatctggtttcacatgactgaaaggaaaagttttcaccttgctttttgtactaataatatatcctggaaatcattctatataaatttatagaaatcttcatttttaaaatagcttcataaaactccattgtaaaaaccaggtgcagtggctcatgcttgtaatcccacactttgggaggccaaggcgggtggatcacctgaggtcaggagttcaaggccagcctggccaacatggtgaaactccgtctctactaaaaatacaaaaattagctgggtgtggtggtgggcgcctgtagtcccagctacttggaaggctgaggcaggagaattgcttgatttcaggaggcggagattgcagtgagctgagattgcgccactgcactccagcctgggctacagagcgagactccgtctaaaaaaaaaaaaaagcaaaaaaaaaaactccattgtatgtgcacatatcattatctgttcaacccatctatgacttgtcatttaggtagtttccatccaatatttttgcaatataaaaaatgctaatgaagaacctgagatatatatatatctatatatatagatatatatgtttgttgttgttgttgttatttttgaagtatgtacgtataataaattcctaatagtgtgattgctgcatcataaggtaaaggcatatgtagttttgttaaatatagctattccccatcttgcattcctacaaatagatgagaatgtccattgtcccatagtctcctttgcagagtatattgtcaagctttttaattgttgccaacctgatgggtaaaaagatatctccaaataattttaattaaaatttctcttattatgaatgaggttaaatagtttttcatatgtttaaaagccagtttatatctttttgtttttttagagacaggaatcttgttctgttgcccaggccaaattgcagtgatgcagtcatagctcactgtagcctcgcactcctgggctcaagcaatcctcctaccttagcctcccaagtagctaggactacagatggatgccaccatgtccagctaatttttttatttttttgtagagatgtgaggtctcactatgttgcccaggcttgtcttgaactactggcttcaagtgatcctcccacctcagcctcccaaagtgctaagattacagccatgaaccaccacaaatgaccctatatatttttttgaattgtctgttcatgtcttattttcatttttctagtagttttttttttaagtgttttagcctaaatttgtaaaaagtttaggggatatatgaagggactctaaatgtttatgaagaaatttaattaaaagataaaaataaaaatataagctttatttttcaacatgagctccatcaagttcaaggcacttttgtaagcaatgatactagccatttagttcacccctaaagaactgagagtcctgggaatttagccatgtcaatgcagtattttttatattggttactgaagaaaaaatgggtgccctttaaagttgtaagattaggaacaaaaacaagtcagaagaagccaaatcagcactgaaaggtgggcacttaatgattacccaagaaaactctcaccaaattgcccttgcttcatgagaggaatgagcgggagcattgtcgtggtcaggaaggattctggggaagttttcccaggcattttttctgctgaagctttggtaactttctcaaaacactctcataataatcagatcttatcactctttggccctccaggaagtcaaccagcaaaatgctttgaacatcccaaaaaagcgcttgccatgacatttgctcttgaccagtctgcttttgcattggtcaaatgccaccacttccacctcttgtgctttgttttcaggatcagactggtaaagtcatgtttcatctcttgttacagtttttttttttttaagaaacccttcaggatcttgatcacatttgtttaaaatttcaactgaggctgggcccagtggctcatgcctgtaatcccagcactttgggaggccgaggcgggcaaatcacgaggtcaggatttcgagtccatcctggctaacatggtgaaaccccatctctactaaaaatacaaaaaattagccgggcatggtggcaggcacctgtagtcccagctactcgggagggtgaggcaggagaacggcatgaacccaggagacggagcttgcagtgagctgatatcatgccactgcactccagcctgggcaacagagtgagactccagctcaaaaaaaaaatcaagtgaaaactctggtcttaaactgcagctgatctattttatttttattttttttcagacacagccttgctctgttacccaggctggagtgcagtggcaccatcatggctcaatgcagccttggcctcgtgagctcaagcaatcttcccacctcaggctcccaagtagctgggactacaggcacatgctaccatgcctggataatttttttgcagctaatctagatgtaatggttttggcacccatctaatggaaagtttgctcaactttaatttttcagtcagaattgtgtaagctgaaccgagatgtctatggtgttggctattgtttctgctgttaattgtaggtcttctttaattagagcacagacaagatcattttttttcctcccaaattgatgtagatggtcttttgctgtgggcttcatcttcaacattgtctcatcccttcttaaaacaagctagctacttgtaaactgccgttttctttggagcattgtctccataaacttttcacaaaacatcagtgatttcaccgttcttccactcaagcttcatcataaatttgatgtctgttcttgtttccattttagcagaattcatgttactctgataggggctcttttcaaactgttatcttattcttcttagtgcctcaaactagatcctattcagacatggtataacaagttagtatgggtttattttggtgcaagaaatattttgaaatccacacatttttttcataatatgcattttccatgaagtttttgaaaactccttgtattaggaatattagtcctttgtccagtaaacagactgcaaatattttctcacagctcatcatttaccttttggcatttttttgcaatgcaatttttttccctttgtttttgttttttgtgtaatgaatcaatgttttcttttttttttttttttagaccaagtctcactctgtcacacaggctggagtacaatggtgcaatctcagctcactgcaacctctgcctcccaggttcaagtgattctcatctctcagcctcccaagtagctgggattacaggcacatgccaccatgcctggctaatttttgtatttttagtagagatggggtttcaccatgttggccaggctggtctcgaactcttgacctcaagtgatccactcacctcggcctcccacagtgctgggattagagacgtaagccactgcccccggccaaatcaacgttttcttatattgcatttaggttttaagtcatagttagaaagcctttccccacacctaggttatagaaacattcattacttttttcttccagtgctagtacttgcatggtttttggtttccacatttagatccctgatctaattggagtttattcttttgtgtgctgagatatggatctgattatatcttttttcccaaatggctatccagttgtcccaatgccatttattaagcacttcatctttgtcccagtgatttgagatagcatctttatcatgtaccaaacttctatagtgccagaagatttttattttttttagacagggtctggctctgttgcccaggctggagtgtagtggcacaatcccagctcgctgcaacctccgcctcacatgctcaagtgcccgcacctcagcctctcaagtagctgggactacaggcacatgccaccacaccaggctgatttttatatttttttgtagaatgagatttcaccatgttgcccaggctggtctcaaactcctgagctcaagaaatccgcccacctcagcctcccaaaatgctaggattacaagcatgagccaccacacccggctgccagaaaattttaatgatcagaaaaccacaattctttcttcctctgttatatgttgaagtaaaatacttcatttagaaaactaagccgggcacagtggctcacacctgtaatcccagcactttgggaggttgaggcaggcagatcacctgaggttaggagtttgagaccagcctggccaacatggtgaaaccctgtctctgctaaaaatagaaaaatttgctgggcatggtggcgggtgcctgtaattccagctacttgggaggatgaggtaggagaattgcctgaacctgggaggcagaggttgtggtgagccgagaccacgccattgcaccccagcctgggcaacaagagcaacggtaaactccatctcaaaaaaaaaaaaaaaaaaagaaagaaaaaagaaataactcagccatacaaggctacccatttggtgagaactaataataagttagatagcaaggtaatagcaaaatgtgggtgcaaaattaaagcaagttatttctgaggagaatgtaggtctcatggaagattttcatgtggacaaatttagtaaattttttgcaggtagtttcctgacatatttaacatttgtgatatagtaaacaataagaaggtactaaaggctgggcgcggtggctcacgcctgtaatcccagcactttgggaggccgaggtgggcggatcacaaggtcaggagatcaagaccatcctggctaacacggtgaaaccccgtctctactaaaaatataaaaagttagctgggcgtggtggcgggtgcctgtagtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaaggtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacagagcaagaccccatctcaaaaaataaaacaaaatagactgggcacgatggctcacgcctgtaatcccaccactttgggaggctgaggtggatggatcatgaggtaaagagatcgagaccatcctggccaacatggtgaaaccccgtttctactaaaaatataaaacttagctgggcgtggtggtgcacacctgtagtctcagctactcgggaggctgaggcaggagaatcgcttgaacccgggaggtggaggttgcagtgagccaagattgtgccactgcactccagcctggcgacagagtgagactctgtctctaaataaataaataaataaaacaaaataagtaaaataaaataaatgtttgtagttccaaaatattttgatgacataatttcttcttgttctaataaaactacatatgcattggtcctatgacctagtaatcacactattaggaatttatcataaatacacacctcaaaaattacaaaaatacatatataccagcttatttattacagcgttatttgtaattgcaaaaacattgtagatagaatggaggtcacataaaacttattcttaagattcagaccgggtgcaatggctcacgcctgtaatctcggcactttgggaagccgaggcaggcagaccacccgaggtcaggagtttgagaccagcctggccagcatggtgaaaccccatctgtaccaaaaatacaaaaattagctggtcgtcgtggcacgcctgtaatcccagctactcgggatgctgaggcgcgagaactgtttgaaccccggaggcagagactgtagtgatctgagatcatgccactacattccagtctgagcaacagagcaagacttcgtctcaaaaaaaaagatcatagatcatcttatcaaatcaaagtatgcaaaatattcaagtaaacttcagataaatatgaaggctaaaccattcagcttcttcaccaaacccttgaatgtcccacctgtctaaatggagatacatgtttgtttgatttattggttaactgtttttattccatttttcctcaaatgatcccataatttgaccttaggaagctgttcaaatagacacattaggttgaatggaaagactactcgatgatatttaggattttaagaggattttatgtattttttccttgtgtgcaataatttaatagcatcttgaataggattttctgatattactaaccctctgggaataatattaggtaattagacagttagctaatattaaaatatgtatcaggtaatatttattgagagtttcctctgtgccaagcaggatcaacttcataggcaggcgacctgtgcggggacacagggcttcatgcttagataggcccccttgctttgaaggcccctaccctttggttagggctctgctgttaccatcttgaaattcttaataatttttattttatttttttgagtcagggtcttgctctgtcgccctggctggagtgcagtggactcactacagtcttgaattcctgggctcaagcaatcctcccacttcagccttctgagtagttaggacgacaaacacacgccaccatgctcagataagttttttgtttgtttgtttttttgtttttgtttttgttttttgtagagatgggactgtccctatgttgctcaggctggtctcaaattcctggcctcaagtgatcctcccacctcagcctcccaaagtgctgggactacaggcatgagccactgtgcctggtcaatcatttttattaacaagcccaagccctcttttttttttttttttttttgagacagggtctccctctgttgtccaggctagagtgcagtggtgcgatcttaccttcactgcaacctctgcctcctgggttcaagtgattctcctggctcagcctccctagtagctggaattacaggcacccacccccatgcctggcaatttttttgtatttttagtagagatggggtttcaccatgttggcaaggctggtctcaaactcctgacctcaagtgatccacccaactcggcctcccaaagtgctgggattacaggtatgatccactgcgcccggcctccaagccccctatttttattttgcactgaccctacaagttacgtagctaggcttagttatgtttttagcaaggaaagtgtataatctcatgtaccttttgaaagattactcaggtctctgcatgtgaaatggaatttagggaatgcaagagagggagtaaaaataacagcgaggaagctatgatagcatttaaggttgctttgactcaggggtagcagtagatagggtaagtaattgatagtttcaaaatatattttgggagtagtaagcattggtatggattagtaatatactggatgtggggatgcagaaaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactacctattttataattcctttttaataaaatattcagaaaaagcaaaactgtggttgcctgaggctgaagctaggaagattgactacagacaagcatgagggaaattttgggggtgatgagagttttctaaaactggattgtggggttggttgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaagtttcatggttacatagctactaggtgtaatatccagtattggaatttgaatctttttgacactaagaccttactctcgatcatataatacattcactttctattttaaagttatattatagccgggcacagtggctcacacctgtaatcccagcactttgggaagccgaggcaggcagatcacgaggttgggagatcgagaccatcctggctaacacggtgaaaccccgtctccactaaaaatagaaaaaattagccaggcgtggtggcacgcacctgtatcccagctactagggaggctgaggcaggagaatcgcttgaacccagaaggcagagcttgcagtgagacgagatcgtgccactgcactccagcctgggtgacagagtgagacaccatctcaagaaaaaaaaaattatattataaatgctgcatctcattggtcagaagctctcttgaaattataaaacaaagaagaaaaaagataaagactgggaaattgtgttgaatcagtatataaatcctgtatactggtccttccatttcccctagaaataagtgatacaggccaggcgctgtggctcacacctgtaatcccagcactttgggaggcggaggctggcagatcacctgaggttgggagttcaagatcagcctgaccaacatggagaaacccccgtctctactaaaaatagaaaattagctgggcatggtggcacatgcctgtattcccagctactcgggaggctgaggcaggagaattgcttgaacccaagaggaggaggttgtggtgagccaagattatgccattgcactccagcctggggaacaagagtgaaactcaaaaaaaaaaaaaaaaagaaagaaaaagaaaaagaaagaaggaaggaaggaaggaaagaaagaaagaagtgatacaacaagttacagcatctttgtttattatccactgtgagttgtattaccacactttacttggctctttggcaaactatattatctcttcagatcactagggctaggaaggcccactggtaacttgaaggagtaaatgtatcttctaaaaaatgcttacttccagggagattggatccacacaagtgaatacatatatagtccttagtgtatgctatgattattttactatgtcagtagcataaagattgctatattaataagcattaagtgcctgctgtgctagacagtgaggatgcaagtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaatttgtgtgaaggccctgagacagggaagggctggggttctgaccaccctccaagtggtgcaatggaatatagtgagagagggagaagacatgagaacttggatactatgcaaaggatttggtattttaattcaagagcagtatgatgctactgaggagcagctggacaattgtgtgatccaattaaaattttaggaagatgaacctcgctattgtggagaatgcatacacaagggttctgttggttcatgaagaggtcttaagaaaactatgagctgggtgcagtagctcaggcctgtagtcccatctacttagaagtctgaggcgggaggatcccttgagcccaaggagctggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 829 - DNA, 3181 bp, Homo sapiens
ccagagctgggcgggttaaggaggaggatggcgccgtcctgcagatgtgcggggacgcgcgcccgccgcaacgtgaggctcataggccacacgcaactctgagcattggccaggacctgtagtagccaacaggacacttaataactgatgtataggtgcgcactgtgtgtccagagctttacgttaaccacctcactgtgtcatctcgctgaggttgtgtggtttactattactgctattagcgcatttttaagcgggaaacctgaggcatgaggaggtaaggagctttgaggagggttgcacgggtgttaagtagcgcggtcagcacctgatccccgtcactcatcagtacggcggttggaggggaatgcctgctggaggggaccacgaactaaactcaatcgcccccacagggtgtgctcgccgtggttcctataaagctgtaagggaggctacacagcgtgcagcgttgttgctgagggatcgcacacttcccgtagattttgttgctagttctggtgcactaacgtggatggactgcttgctgtctgtagggcctgcccacggtcagcgctacagaattcaggcccggcgtagctacttccaacccttcagatcttcacttcctgttggaactgtcctctagactgtagcctctgccagaaataattcattttgaatacccttgtaacacccaattccttgatctcctatcattcccctggcagggtcagtcctcgaccttgtccccccaaattgcttcgtctctgaatccagactctgaagttcggctctgcctaccaccttaagttatccgatgtggccttaccgtcagcctagtctttgactacaggaagacctctcttcctgaagaagacgcctcttttcatccattcactctggaaatgattcaacgtctgcctgctgctgatgctttactctccaccaggggttttcgaagtgtgcttccccattccccctgggcctatagcatcagcatcagggaacttgtcagtaacgcacattcttgggccccaacccagaactactgaatcagaaacttggggtgagggcctgtcgtggtggctcatgcctgtaatcccaacactttgggaagcagaggagggtggatcacctgaggtcaggagttgaggaccagcctggctaacatggtgaaaccccgtctctactaaaaatagaaaaattagccagatgtggtggcgtgtgcccataatcctagctactcgggagactgaggcaggagactcgcttgaacccaagaggcggaggttgcagtgagccaagattgcaccactgcactctagcctgggcgacagagtgagactccgtctcaaaaaaaaaaaaagaactcagggtgaggcccagccggctgtggttttatgagcttttcaggggatactgatgcgggatcaaatttgagaagcactggtctaggtcttagatcctcttgcttcagtttcgtcattggatctcaggaatgttcagctgccctctcaaggcaacttcttacttcacttgaccttccaagacctctcgttctgtcaaaccccaattttggatcaacccaggcatgcttccctcatgtgttccaaagctggtcagagtagtctacaccactatctgcttcaacttctagtaacgtctaagccttcagcagttttgcttatgaaactgcttcactgaagttctccaccaccaagtagtcagctggcatcggaattcggcttgtgtcaaatggaactcaacatcttcctcttcaggacatcccctattttcatcctcccagtgaatgacaccaccaagttaaagcctggaggctgggtgtagtggttcatgcctgtaatcccagtagtttaggaaaccgaggtgggcagatggcttgcgcccaggtgtttgagagcagcctggccaacatggcgaaaccctgtctctacaaaaaagtactgccaggcgcggtggcttacgcctgtaatcccagcactttgggaggctaagcaggcagatcacctcaggtcaggagttcaagaccaggctgggccaacatggcaaaaccccatctctactaaaaatacaaaaattagcctggtgtggtggcatgtgtctagtcccagctactcgagaggctgaggcaggggaactgcttgaacccaggaggcgggggttgcactgaacctgttgcgccactgcattccagcctgggtggcagagcaagactcttatctcaaaaacaaccaaacacaaaacaaaaattagctgggtctggtgacatgtgcttatagtcccagctacttggggggctgaggcaggaggattgcttgagcctgggaggttgaggctgcagcaatgagctgtgtttgtgccactgcactctagcctggacaacaaaatgagaccttgtctcaaaaagaaaaaaaaaaagcagggtgcagtggctgacgcctgtaatcccagcactttgggaggccgaggcgggcggatcagaaggtcaggagatcgagaccatcctggctaacaaggtgaaaccctatctttactaaaaatacaaaaacttagtcgggtgtggtggcacgcacctgtagtaccaactactcaggaggcttaggctggagaatcgcttgaacccaggaggtggaggttgcagtgagccgagattgcgccactgcactccagcctgccagcctgggcaacagagcgagattctgtctcaaaaaacaaaaacaaaaaaacccagaataactcaccccaaacttccaggttttttttttttttgagacggagtcttgctgtcgcccaggctggagtgcagtggttagatctcagctcactgcaacctccgcttcctgggttcaagtgattcttctgtctcagcctcctgagtagctgggattacaggtgtgcgccaccatgcctggctaaattttgtatttttagtagagatagggtttcaccatgttggtcaggctggtctcaaactcctgacctcaggtgatccacccgcctcggcctcccaaagtgccaggattacaggcgtaaaactcccatgctgggctggtcaaagtgctgggattacaggcataagacaacgcacctggaacttggcttgtgtcaaatggaactcaacatcttcccttttactaaaccccacccaacattcactgcg

SEQ ID NO: 830 - DNA, 45426 bp, Homo sapiens
atggtggagcagggagacgcggcgccgctgctgcgctgggccgagggccccgccgtctccctgccgcaggccccgcagccgcaggcgggaggctggggccggggcggcggcgggggcgcccggccggccgcggagccgccccggaggcgggagcccgaggagccggccgccccggaggtgctgctgcagcccgggcgcctggagctgggcgacgtggaggaggaccaggtggtggccgtgttcgtggtcaccttcgacccccgctcgggtgagggccgcgccggggccaggcgcgtggggagggtcggggtgcccccgagctttgggggcgcgggggaggggctcgctgcgcgcgcacctgccctcccggccccgcaccccgcaccagggccggccccgggctcccgggcttggggaagggcgggggtcggccagtcctcagctctctccctcggggcgcagctgggtgctggcgcgcggcctctcggagcggccccgagggctttgttccagccccgccgacctcctctcccctcccctcctctcctctgagtcccagccccacagtggtgttcgcacttcagtgacagggcatccggtttgtggccacgttgggttttgttttcttttcttgggggctagaagatttttcacgttgtgcggaggaaaccccccgggcgagcgccctgagctccccgctcgccccccatcccgtcccccgctccccgctcgccccccaccccgtcccccgctccccgctcgccccccaccccgtcccccgctccccgctcgccctagctccccgtcgcttcctctggggtaactttcctagcggccaagttcactttctctgactgcattattttgaggaattaacgccgggagcattaagggatggggctgagggattcagctgaaggctgattaaaggagaagcctccccggataggctgtctttcggagatgcttggagaattaaagtcttatcccacataatcttagcctaaccacccggcaggggggtgtgcgttttccaggtgagagtccacgggggacagaaggtggaagaacgaccctgcgcgcccaggaagccttggagggtcagctagggacttctgactctgagagtggctctgctgttcggggttgggggaaggaggtgtcatcgcaggagtcgtggtgtcagggcttaaggaaacccaggtgtgactgtcaatgtctccagggcagctgctggagtgtggagtgcctgttcgtgcgggaaaatattggctgctttctgggatgaggtgggatggagtggagaaaaaaaggggttaggatctggagaaggggaatctggtatggcagctgatgatgggttccaggccggtaattttggggttctcagctgtaggacacaggaagaatgtgggattcactgtggagctccatttgcagggacagagtttgtggggacaattcaggcctttgtgacttctgcttgtttctttgccacattccatggctttcaaactcttttgactgatctatcatgtgaagttaattttacatcacaaccaatatgctcacatacacgtacagtacttatgtaactgaaatagacatttcatgaagtagtgctgactccttctacatgtaatgcattcttttttctctctcttttttttttttttcagacagtgtctcactctgtcgcctaggctggaatgcagtggctcttttctcttttttttaagtgttcatcacacatgctggttgactcgcatttgagattcctagataccagtagtttgaaaagtattggtcttttttgaccaaagttacccgtaatgctagacaaaaaccaatactttgtaactaatcatattgcttatactgtaccccatcatttacaggtaaacagctaccagcatttgacttatcctgggaaatatttcagagtaactagaaggaatagaaagggcacattcacacggtctgatttagtattggtagctccagtggtagagtcttagggaagggaaagagaaaagaagttttatactaattacagacagatagggtggataatactgataattgatcaattattgatattggccaattgatatctatcaattgataaaagcgccagagggctagtacctgcccccattccttgtcagtcacaggcagtgagcatggctttgtgaatttgtgtatacggagtgtgtgtgtgtgtgtgtgtgtgtgtgagtgatggttttcagactaaggctactgtgcaaagaagggattgtaacacatttagacattttgtgcaggcattttactataatgctgtttgatttattctgatcactgctctgtaatttgatgatcatttatacccaatttgtaaatgagggaacataccagggatggttaggtaatttgggaatattaagtagccaataaatacttgactgtaagtcccattgtctttctagtatactatgctgcctgaacccctgctccctggcacctgatccttacttatccagggatggaggagaaaggagggaggaagagagagcgcagtgtgagagggagcacttgtaacttgtgttttttttgtgtttttttgtggggggaaagcagtcctttactgaccataaatgtgtttgtctcttttgtcatctatcctagtcctaaatggcactttgcttcctgtaaaaatactctgatagaccttgtaccatataattttattttatatatatcttaaaagtaggagatgtagtgaatgaatgctactgagcttctgagggcctcaaggttagcactaggacagggccctcagagagtgcctgatgtaccccttgtgtgatggttccggtggagtgaggcccatagtggcacagtgagctggaccatcactggcccagcatcttcccccctttactgctgaggcagatctgctatttgttcctatttaatattggcccacccagacttttgcccctccttcgcctgtgttgccaaaagcgataaagtgaatattgacttctttaccaaaattagagcatattttagaagttcttacataggtgtgatttgtctgctgtttagtttctctcgctggcctgcctgcttagccacttccccatgtctctcccacctgtgtcctcagtttccactcctaggagatccttcctccccccaccccacacccacctcaaccctccgccacccccatcacttactgcccaggccatggcattatgtgcatcttcccatgtaatgtgggtaactgttggcatgtgtccaaatcagtgtgtgtgcctgagagagagggagagtgaaagaggaagaagagaattcatagctgtacattcattaggtagtagagtaagagggaaaaggaggggtggatccttgttagaaagggtgtgtgtgtgtgtgtttgagcaggaatatatgcagtgattctctaaggtgtggaaataagagtaatccttttgcacttttagatacaagttttggaaagctaggctggccatctgtgggaagaatcagagaaagagtcttaaagcttatttccatcagactcatggattgaaaattatggttgctgagtctacaggtgacttaagaactaggggcttcaggttcaaagtgaggcttacacatacactcagtcctcatctggagcagggggccctaggatggtggtgctgatcatctgggccacaaagctgctattgaaaccagacccagatgctaactctgcaagctgggtggaagatgttggaagccagaatattgctgtttcattttgttcaaccccatgatttagagccttgattttaattttacttcattatttgggcttctagtaaaatgttcttagtctgcttaattaaaggagaggatattgtcacacttggggagcacccctgcccccagatggtggcaagagcggtatcaccgtgtggctgaggacttgtgtgtgggcaggatggaggccgatgaagctttgaacatacaatgtctggacatctttgcatctgcctcattagactgtttctttataagagattcactttacactgctgcgtttagagttttattgtgggtgtctgggagaaattcctgtgctccctgtgtttgtactggggcagcttgcaagaggaggggtaaggtgagaggcagatcacctgctgaggttttcaagatgtttctccctttcttcttgggaatgaatttctacctgttcctcagcctctagccagtgcccagattacatctaaacacctatttaatttaatgtatccgagcgcttctatgtttatgtcacatgagtacatttaaaatcacacacactaattttaatctctgtagattccctgtatagtctatgaaacataagcattttttttttaaacaatggagatgatggaggcccagtgagaatagggctaggtctggtgtctgaggcaccacttggagcgctgcccaggtcatctgactcgtggcaaataataaatggctctagcaatgggtgggaaagtgacaaagtagaatgtgaatggaaaatttggaggacaattttaagatgcaaagagcagtcgtaagcatggacagctcaaatgcaggcaaagaaaaagcctgttctgatatccggccagaacgtctcgcaggaagagaaactctgtcatgtcgccatccttcccctgtatttccacctaatgccagtggaatacaattgtggttcatttgcttaatcccacccgggtagaatctttcccaggctgttggtgattcacctgcttgtggttttcagggagaaatcagtttgtagccatctgctgtgaagtcagtttcttctcttgaaaattgaggaggggaaaataaaaatggtaattgtaatacccaccacctcctgagtgcctgctgtgtgccaaggactgtgccacatgtttcagtgacctgcctctgatcctcccaacagactacaccatcatcatgagaaaaacaggtgcacagagccattaagttgtctaaagttagggccagagcccaagtctacctgcaccccttatccacaccacactaccacccagtggagaatgatatgggatctgtgaaatggaaggtctttctttgtaaagtgaatgcattggaattcagccatggattggcatatagctgactttaaatcagcaggattagcttcttcctgactcaggattctttatcctgatgcttttctctttgctttggatgtgctctcagactaggtggttttaagactgtttcaaaccatgtaagacccaaagtcaactcacctgggttatttacttttctgatgttagggtctgaaccaaatactctttggaggtttccacctgtgggatctgatggcccctttaggtggttatgtgaagggaatgtattgttgggacctagaatactctttgattcatgcctttattcctgaaacaggatttgttttgacttcctgattacaatcagggcatatgtatacacagatgggaagagaaccgtggaaagagtaaaacctcaggcacgtgctggggtgggagttccactcctgaggtcagaggagctggaagaggatctccagctgaggcagtctctggataggaaatgaagagctcaggaggaagtgcttgcttgggaaccatctaacagaggaggaagaagaaattcacatatttcctattaaaaagagattgttttggttcaagatcattgctttctctattttaaatattttgaggtgaactttctagcagacagcagttactgcagttaatgtccaatctccctaggaaatagtgatgaattttaagacagctgggggtttggtcatttctcatttaaacagaactagttttggaagacagaggcagtggtcaacctagataggacagcctacctctggcctagcccatgggcttataaaaccccagctctgggaggccctggtgcacagagctgtcaggctgacctttggagctgtgaagtggcagggttcagaccatctgtacatcctcagccaggcgcgacactgaccttctggctttgcctgggtaactgagctgccagcctcgtagtcggttagtccaagttcctttaaacagagacatatttgcctttgcatgagctcagcacctggcaggcaccgtgctgccaagttgtgctccaccaatatttgttcaatgaccagctgaatgtacacaatgcatattgccacatttgtgcctcccgtggtcatgtgaatccctcctcagaagttgtctttgcagtagaggctaggaagtgcctgtaagtacctgtaataggtccaagtcatggtccaagatgagaaaggacacagagatggaaagagagcaagttaggggagaaaaaggcacttgtcactggcacctcctctctttgatggactagccatgagatgacctcttttgttgaatcttccaggccccagctccctggctgagttcttaatacagtgaggatatctggaaaacctaaaagcatggaatgtgaagactgagcctgggataagtagcagtcaggatgagtttctttctggtattaaatggcatcccataaggattactaattatgcaaaatcactttccattaagtctcctcaaattccatatgtaagctggttttcatttgtaatgtttctgtaggataacttcaagccctgatagcgcttcattccctattagtgtggtgcattgcctcaattatttttggcttttgcaaagtcctttatgctctcctttttttcacattgctattatttcaattattttccccaatttgtaagttgaaatgttttgaaaagttgaaagaatagtgcagtgaaaacctgtatgtctttcacttagagtccccgtttattgacattttgccccatttgctttattcttacatagtcatatcccctataacatgaaatatatgttccaaaaatcactgtgcggcaaaaaaaaatcatgaagtaaaaatcacagggcttatgagaaaaactttgtcagtggcacattttttttaaaaaaaagataggaacctaccaaaaactataggacagttttgcatatgataaatggttaagaaatacatacttagtaaatgtggaactgtacctttaaaagacctggtgtttgtatctggaggtgagtgctgaaaggattgagcctgtgaattactatgtgtggtgggaggggggctgtctgaaatcagaggcaaaactgtgacgctagaggtgcatggcatggcccagaacgaggtgacctgaggtagcaggagaagcttaaggtgggtgtgttttgtatattccgacatggcttgattcagctgggtgtagttttccacattgactttgtgtttttcatgattgaaatcacacataagcaaatgtcaaattccctaatacattgattgctttggaacagattcaacaagcattatagcagaactgactgtgtgtggagatataaatagacttttcttttttttgctgaactatttgaaagtaagttgtggatgtcatggcatttcatttctaaatttttcagtatgggctgggcgtgaatacatatactaacgcctgtaataccaacactttggaagacagaggtggaaggatttcttgaggccaggagttcaagaccagcctgggcaacatggcgagacctcatctctataaaaatttaaaaaattagcccggcatggtggcgcatacctgtagtcccagctgtttgggaggttgagatgggcggatcatttgagccctggagttagaggttatagtgagctatgattgggccactgcactccagcctgggcaatcctgtctcttaataaaataaaataaaatacttcagtataaatctcctaagaataaggctatttttctacatcaccatagtatcattgccactcttagggcagttaatttaggttaattcatcaattaggtttttttaaataattaatgtattttattttttagagcaattttagttttacagaaaaattgagcagaaagtacagagttcccatatactacctccccctcactcatacacatataatttccctttattaacatctttcattagtgtggtatatttgttataattgatgaactaatattgatacattattgtttatttaaatccatagtttgcattaaggttcactgttgtacagttcaatgggttttgaaacatgcacgatgttatgtatccaccataacagtatcatacagaatagtttcactgccctaaagatcctatgcttgacctattcatccctcccttcctattgatctttttattgtctctataattttgcctttcccagaatgtcacatagttgaaatcatatagtatgtagccttttcaggctggcttctcttatttagctacatgcatttaaagttcctccatgtctcttcatggcttgatagctcatttttctgtattgctatagagtatttccttgtatggatatctcacgttttatttatccattcacctatgaaggacatcatggttgttttccagttttgggccattgtgaataaagctgctgcaaacatctgtgtgcaggttttgtgtggatgtaagttttcagctcatttggataaatacaaaggtgcatcgttgctgggtcatttgataataacatgttagttttgtaaaaaactgccaaactgtctttcaaagtggttgtgccattttatattcccaccagcaatgaattcctgctgtcccacatcctcatcagcatttggtgttttgaatgttagccattctgatatgtgtgtcatgatatctcattgttattttaatttgcaattgcgtaatgagcatatgaaaaaatagtcaacatcatgtcatttgccatctgtgtatcttccttgatcagttgtctgttcagatcttttacccttttaaaaagttggattgttttcttattgttgagttttatgaattcttcgtatattttagataacagtcctttatcagatatgtgttttgcaaatatcttctctcagtctgtggcttgtcttttcgttcccttaatagtgtctctcatagatcagaagttttaaattttaatgaagtccaatatatccatttttccttcatgaattgtgctgttagtattatatctagaaactcattgctaaacccaaagtcacccagatttttctcctgtgttatcttctagaaattttataattctgcattttacattttggtttacatattttaaaaaattattattattttagagacagggtctcactcttttgcctgggttgggatgcagtggagtgagcacagctccttgtagccttgaactcctgggctcaagtgatcctcccaccccagcctcccaggtagctagcacgacaggcacacaccaccatgcctggctaatttttttttttaattttttgtagagacagggtctcgctatgttgcctaggctagctactttccatattgaataaatttttgtgaaaggggtaaagtaggtgtctagtttcattgctttgcatgtagatgtccacttgtttcagcaccatttattgtaaagactgtcttttctccattatattgcctttgttcctttggcaaagattatgtgattgatttgtgtgggtctgtttcaaggctctctattctgttccattaatctatttgtctgatatttcaccaatacctactctcttgattaattttatataagtctcgaagttgggtgcattgttcgtcttccaattttattgttcttcagtattatgttggctatttggggtctcttgcctttccatgtaagctttggaattaacttgtcgatatccgcaaaataatttgctgggattttgattgggattgcattgagtctatagcataagtgaatatgaaattccctgtgctcaaattgctctcaagtacatctgttgcattgacacaaatccagtaagtgataaaagtagaactgactatatacagatatggatatgcctttttttcctgaaccatttgaaagtaagtcacagatatgataatatgtcactcctaaacgtttgagtataaaccttctaaggataagaacattttcctatgtaactacaatattattactattgctaaggtaattaacactaattcatcagtttttttaaacacatgcgtgcccttaataaatctgtttttttttaaatacccattctgtcctgtgcaaggcatgatactatatagaaatgtgaagacaaggaaaattctcaccttgtaaaagttaacagactcctgcagagacagacgtcaaagacatgattatcatatgtagagataagggccatagtagctctacctacttccctttcattcaaggagttgtcagcaggaatgtgcttgccatgggataaggatacctctccccagagtggtgttctggagcctgtgccctgttctttgatttgccagcctctaatggacctttcttcccaacccagatgggcttatgtccacctaggagtgaaggatgtaactaacagtatgtcattcgctccctctgttcctttccatttctgtgcaattagatttggtaggcacagaggagcaaggaagagggtttgagaaccaggctaaggaatggggactttatcttctaggtcagctgtactaagtaggacataggctggacatgaatactagaagcccaaatcaacagtggcataatcaagataggagtctatttctttttcatgtaacgatcaggtgatagcagcctggggctagaatactggcccaaatctccagggtcatccagggacctagacccacgttgaccaatggctccagcatcccctctgtgatacgatgctacatccacattccaggtagcagggtggagaaaggggcaatgtgctccttgcctttcaggcaccttctggaagtgatgcacctcatttctgtccacatgacactgaccagaattcactcatgaaggtactgagaaacatagccttcatttggaaggccatgcaccaagctaaaaataacaggttctgattcatataagaagagaagagtggatatggaaggacagcttgcacacctgatatacctgtatttctttttttttttaaaaagtgccttctataaaattagtctcttaagatactccttttaaaaagatttaagatactcctttaaaaaagataatttggggaaacattaagcactgtattgatctcacggagattcacgatgcagagtggcatattaaaggctctgagaagtacttcaataaaggaatgtgtctagctttgtttaagctaagataatttggccaaaaacacacacatttcacaaaattttgttttcttttttgcagaagccctattaacctaagcttgggaaatactactttgggaatcattgaaagtgtcttagtttgcagtgacgcaaacatttttaaagcaattctattcctagggatgtagtcagtagaaatgtgcatattgtgttggtcaaagttcaatcagaggaaccgaaaaactaggagatacataaaggaatttgttgcagggatttggttttatgcaactgtgggagctgttagacaatctatataaggctgttctttgtatctgatgttggagtttgaagtctactgggcagacagttatgaaggaagagagtaaacttctgaacaagaggaggaggaggaggaaaaggaagagtaagaagctgaaactcatgaagataggtgggaacgcggatcaggctgttactgtatccagctttggtgatgtgggtgtcctaaggagaagccgatgccctttattatggaactaaacatacacctggcttaggagtcagagaaactgaaggaagatcaagggatggtggctgcagcatcatcagggctggctgctgcccctcaccactctagtaagcctgcagagaagcagctatgcagtggaccttctgcactgaccttacagatgcaaacataacgtggctactgattcacttccaaatctcagctggaaacatacaaagaagggaattctgagaaggatagttcagcccaaccaggtcaatgcattacaatgccactttacgctatttcagcagatggcaaatacaggattgtttacagcagtgcccgttgctgtaacttcaaattggaagtaacctaaatgtgcatcaccagttaagcaggtaaactgctacatgcatatgatagaagtaatagatgaacaaactgttgctacacatatcagcatggatgacataaaagacataaaagcaaactataattacattttgtagaaactcagaagaggctaagctaattcatgagagagggttaatgacttggagctgctatgagggaggtttctgttgtacaaataatgttctttcagcttcttgatctgggtgctacttacacaaatatgtttactttgggaaaatccattgagttgtactttgtgcactttttttaaaagtttaagttccaggatacatgtgcaggatgtgcaggtttgttacataggtaaacatgtgccatggtggtttgctgcacctctcaacccatcacctaggtattaagccctgcatgtgttagctatttattctgatgctttttcttccccttccctgctgacaggacctggtgtgtgttgttcccttccctgtgtccatgtgttctcattgttcagctcccacttatgagtgagaacatgctgtgtttgggtttctgttcccatgttagtttgctgaggataatggcttccagctccatccatgtccctgcaaaggacatgatctcattcctttttatggctgcatagtattctacggtgtatatgtaccgcattttctttatccggtctaccattgataggcatttgggttgattccatgtctttgctattgtgaatagtgctgcaataaacatctttgcacttttctatacttatgctatacttcaatataacatttgggtaaataaagttttaagacactgagtagtcatgggcaggctgggttggaggaaagaagctaaatttgagctagctgaaccccgtaatgtgtggcgtgtgggtaaacaaggcagtaagtattagaagaagcaggttggttgagtatgaggaggacagagcctatcgagggtcattgtagctctgtcccagacagtccctttcctctgctgaccatatactgccactgttaagcgttaggagcgtgtatacagaggcccaagcaggggctcttattgctggcatgcatcagcagaatcaccctgtggcagggcagggaagatggtgattctatagacctagggtagcccctggcaccttttaaagctccctagctgtcctgatgcattccacaggaaaaaaacgactggactgtgaaggtaatagacatggatggtaggggaaaatataggaaagcgtgggggaacttggtgcttaaaaaactcgtcttatccccaaggtcacccctctttctttctgagtgctttttcttatctttgaccctgacaaacataacattgttcgaggctttctgctttatgaactcttaattcctttttcatgcttttcactttagtgaattgactaaatgatcagaatcataattcctcttttgaaaataaactatttgaaagtgacttgggctgttgagtgtgagattcgacaatgctctatgatatctaccatgtcctgagactagattgtgtattccctgatgccctgaacaattatctgaaagcgttgtttggctgggatcattgatggtttttctaatgcctagcaaattaggatttggagtgttaataagaagtttgttctgaaatgaaatctcacaaatagcttagtgttttgctttaaacccttttgaatatgcatgaaaacaacagggagtattctatagtgttctctcaagactctagataacactgctattgtgtagttccctgattcccgcagcccgaggcatgcttgtacttttaaaatcctactttggcctagagcggtggctcacacctgtaatcccaacactttgggaggccgaggcaggtggatcacctgaggtcaggagttgaagaccagcctgggcaacttggtgaaaccccatctctactaaaaatacaaaaaaaatagctgggcatggccgggtgcggtggctcacgcctgtaatcccagcactttgggaggctgaggtgggcggatcacaaggtcaggagattgagaccatcctggctaacatggtgaaaccccgtctccactaaaaatacaaaaaattagccgggcctggtggcaggtgcctgtagtcccagctactggggaggctgaggcgggagaatggcatgaacctgggaggcggagcttgcattgagccgagatcgcgccactgcactccagcctgggtgacaagagcaagactctgtctcaaaaaaaaaaaaaaaaaaaattagccgagtgtgctggtatgcgcctgtaatcccagctacgtgggaggctgaggcaggagaatcgccttgaacctgggaggtggagcttgcagtgacccgagattgtgccactgcactccagcctgggcgacaaagtgaaactcagtctcgagaaaaaaaaaaaaaaatcgcaccttatcctctgtcataacattgatcccactgcactgtaactgctgatctcctctagctctcctcatttctctctggaatctaatctcactgaggtcagggactttgtatctccagcatctagctcaggagaaactgaataatcaatgatgagtgaatgagtcccaaaattctggaagcaaatatcattgtcccttgaagaaggacctcacttagagaggagagagagaggaggggaaacagagttacattggtcagagaggtaggaaaagcactaaaatagtattctatcatgaaaatccaggaaaaagaggagaaatgtttgaggaattagcaaatgctacctagaggtaaacgagaatgagaatttaaaaaatgttttgggattttttcccagtcattagtggctatagatagaatcaagatctcaagggattaaggggagaacacaagataaggaaatgagggtggaaggttaaaaaaacatgcagagaagtgaggctacaaaaagcagatttggaagtggttgagcagaatgacagaagcaaacgcagcatcctcatgagggaggagaacagtgtttgagggcagaaatgggaggttcttttagtgtccacctccacgtcctccggcgtcacccctgccagtgatggaggggctgagctctgagcatctcgctggtctgtctgaggctgagtcagcagtcggtttattgaaaagccatgtgtgctaagccctgtactaacccattttctttgaatgatgttgtttcttttaacttgcatcttccttttcctgcaggaaacatggtagaatggtgcttacctcaagatattgaccttgaaggtgttgagttcaagtctatggccagtgggtcccataaaatccaatctgatttcatgtaagtacttctgaactggagtcatcttcgtaccattccccccacctccacactttccccaaagctgaagggctcttattaggaggtcttcgtgtgctgtgtgtaaatgccttgaaaatacatggatagttttgtgtttacatcatttttctagtgagatgtctagctttcatcagattctcaatgggcttcatgacctgcaaatcttaagaatccctgcctgtagaggttctctcactttctcagaaattacatggacctcacttgaggtttggttttaatgaaagtgcacagtttcagccccgtgtgagttaactgaggatatctatgtgttcaaccttgaaatttcagctttaagtaaggccattttttagtcctgtgtagtggggcattcagagagttttgcgagaaggaacaatggaaagagcttaagggtaatgaagtggctttaatctcctcatggggcttaattcatgattgatacaagtgtgagaagaggaggaaataaaatggcagctcagtgaaaaatatcagagcctcaggaagtaagggaagaatcactgtggtttatgctacgaaagagagtccaagttccagaggagcctgaagaggaatgttggttctgcttcacccatccaagtcattagtcgtggtgcaggagagaagagatgtgtccatgattgtgggcagctgagcggcaggcttgccacggactaagtcccagctccagccaagtgacccttggcaagttatgtaatctcttcaagctcatcagtgaggtcatgtggcttggcccgcttgttttcttgaggctgagctttgtcattgacagccccgaacacagttcatttgttttgtttaggattgcatctcaaaattcctctctgatcttgagccacactacgtatttggtctcttctagctatttccgaaaggggcccttcttcggcctggcctgctttgccaacatgcccgtggagagcgagctggaacgtggcgcgcggatgaagtctgtgggcatcctctctccctcctacacactgctttaccgctacatgcacttcttggagaaccaggttcggtacgtggcttccgtacatgtgcagggaggcagcaggatccaccagctggtgcatatggcacgagccctcggagacagcatttgcgtgccagagcagcagatgtctttccaagaacatccatggcgatgtttcacgcctcgggtggtgtcctttcgtttcagccaacgtcctgcatgatgagtcttcactctataatgaaagctggggtatattctgccttcagtttggatttaatactaccatcactttttaaaattaagtcattttttgacaggtacatgatctttgtttatgcaaagccgcaatagttacctccttgccccaagtaggcaaagaaatcctaaactttcttaaagcctacttcttttattattgggattcttactatgattgggataatagaaagagaacttaaaaatatatatatatatatatatatatatatattttttttttttttttttggtagagacaggctcttactatattgcccaggctggtcctgaactcctgcagtcaagtgatcctcctgcctcagcctgccaaagagctgagattataggcatgagccaaggtgcctggcataggaagagaatttttaacagaagcagcaaaacgattagttactttacatttttttcatcatgcaggtaacctaattacatttcagattttgaggggaaaatttatccctaatccctgaagcactgacaaaatgttaccacttcttttctgtgtatgtgtgtacgtttaaaatatatatttggcatcatacaatatatatcctcttttatagtctatacttttaaaatttatcactacgtaaacatttttatgcaacataattgtgatcttcagctttgaacccatgaacttgtttgtggaaaacacgtttattatttaaaaatttatatgaaagtacagaggatttttaaaaatcctctcatatattaacactcacagatatccattgacaatattccatgaatgcaattctagaatacaaatatctttacaaaaataggattaatattttatgaatttaattttctcaaatagcaggctgtgttaatgaaatatattaaacataatttgacttataacttcaagtaaatgttttttcacagtaagatatactattccttgaaatattcctccaaaattaagaaaaacaattatgaaaaacgtgacaatatggtgtcagtactttactgggaaacaatatataaacattaaaattgatcaggaatggtggctcacgcctgtaatcccagcactttaggaggccaaggaggatcaatttaggaggatcagttgaagccaggaattcaagaccagcctgggcaacaaagcaagattccaactctacaaaaacaaaaaaattagccaggcatggtggtgtgcacctgtagtcctagctacttaggaggctgaggtgagaggatggcttgagcccagaagttcaatgctgcagtgagctatgattgcaccactgcacaccagcctgagtgatagagcaagaccctgtttaaaaaataaaaaaataaaaatccttaatggttgaattttaccatcaagcacttttctttctttgaaaggatcttgcatgattaatactattggcctgttccctttatcctcagctggttgtacaattcttgaatgctttcttcttcccctgaggatgctatagatattgttctactgttatctgaaattagtcgttttggagaagtttctccatccagatacctatagagtctgtctttgtctgtgctgtttctgaacttgccaaatgttttgttttgttttgttgttgttgtttttgtttgttgagatggagtctcactctgtcgcccaggctggagggcagtggtgtgatcttggctcactgcaacctccgcctcctgggttcaagcaattctcctgcctcagcctcctgagtagctgggattacaggggcccgccaccacagccggctaatttatttatttttttttagtagagacggggtttcaccatgttggtcaggctagtctcgaactcctgacctcgtgatctgcccacctcggcctcccagagttctgggattaccggcatgagccactgagcctggcctgaacttgccaaatatttattagttcatatcagtatgttctgggatagtttgtcccctttgctcaatagatagttcttttatttttaattttaggaactttttcttctttaataaaatatttaacttttgcattctgtttttttcttctccaggaatacccatgatgcatatgtttttctcccattgtcttccctgtttgtcattttgatgcttattttaatagctcttcaatgctggagctgtcctatacatttacttggttattctctgtggctgaacatgcagcatgtttctatttactgtttatttttttagctgctcctctaccttttggagctgtggaaaatacatttgcacatatgtctttttctgtactcaaaatatttcctcagttttttttttttttgtctcagaagtaatattatgaagttctaaaaaagaccattttattgggattttgacacttttaaaacaatattattccttttaaaaagctaattctccaagtaggcaatacagtttcatggttcaaaatccaaaaattttaaggtggtattatattggatagggtcctggctaaaaggcaagaacagaggcccaaaattactatggccggattacgataaaagattattgctcatgtcatagcgtagaggtaggcaggtggtcaagttgggtagcctgctctgttccatacaattgttcagggacccacattcatctcttgttattccaccgtatcctaagaatggttttgtattgtaaggtgctctttcccaaatgttaaaagctgctcactactattatgtttgcatttcagcccatagggaagaaggaaagactagaatttacatatctcacttctcatattccattgtcaagtcctcaatcacagagacacacccaacagcaaagtagcctgggaagcatcactactaggtgggtgaccctgtgaccagttagaactctggggcattggttacaaacaggaagaagggaagacttgactttgagaaaaagttagcagcttctgcttcagtttgcccctctggccactcaggtatccatgtatactcttcttcccccttgtagaggccattcctcccaccccaaaggagacatcacagagtctcattcagttcatgcttccagtctaaaatctaggatttctctgtagtgcgcagtagtcctttacgttaggccagggcatggttcttcttaccctgaaaacttataaaagaatagacaagtccctctactccctacctcccaaatgcaatataggaggtaaagtaggaaccacaatacaagcttctgtttggaaaagggaagaatgagaaatacggatggtcactagttcataacaacagtgaaattctgctgagcaagaattgcagagtcagtatgctcttggctcaactttggttctgttgtgtagaatcccttgtccattgtcctccatggcacttggctttgtcttctagaagattctttcttcattttcctccataaccacatctacagtgggcattggagaacatgcctttcttgaggctgtacagctttagaacacctttcctgctggtatagatttggaggtctagtggtttcttaaggggtcaagaagtcacaggcttttataagccaagcatgtgacaatacatgtctctcaaaaactaaattgacttctcgtttgtttgcttccagtcagttccaggtaaaatatccatggccaaagatcttctttgggtcattgtttttaattagcagactagattatagttactggcctctctttttggcccatccctttctccctcattttcataataacttccttgaggtgattccctaaatctgatctttgtaaataagctgactcccttgtctgcccaagaatactaaactggagactttcatagatgccctgagagagactcctgtctcctgcttttggtgtacagtagcattggcttttccagccctgtggggtcccaaattgttggaatctcagtggatttatattgccaaatttagaacacatgacccttagtaggctgtattttattccgtttttccttgcaaaccagccagttcttgtttgtttttatcttattcttacagtagctcactaaaagcatacaaggggcagtcaacacacaccagcattctactgccaactgcttcccataaagctacaaattcagatgacacagggtctcccaagttattgaagttttagcagatgttttgctacaagtgtaacaagggttgccagctttctagtctgcaatatctattttctcaccaccctccccttccagcaacaaagccagtgtctctatatggtttttgatactgtagtaactcatttccaggtatcgtttttggcttttagagtataggctaagttgctataatgaagaagagacccccaatacagtgacacagtaagatagaattacagcttttccagcatggcagtcgtagtagttcattgtgggtaggtggttctgttccactggtcattcttggacctgagtcattcagtcttacattatgtcattttctagagttgttgtcctcatccacatggtagaagctgtctccccattacattgtcattttctagcatgtaggaagagggaaagaccttggctccatggaatgtgagcagaggtgctgtgttcaacttctgggatctggaacttgagtgatctggaagttgaacacaccacctctgttcacattccattgaccagttcttggttactaggcacacatagtagcaaggcaatctgggaaatgtggcctttagctgggcgtccgtgtgtccatctaaaatttggaaggttctgttactaaaggaagaagagtatggcagactaccactcacataaagtgaaaaatcttcacccagttcccatatccatccaaataatctcagtaatcacagttcatttctcatgtatcatcccaaagtgtgtgtgtgtgtatatatacaaatacaaatgtatattcttactgtctcccttttcttgcaaaagatagcatgttatttgtgttgttttgcacctagcctttttcattcaacagcatgaaagatctcatatcagtaggttgagagtttcttccttgttttcagctgtgtcatatgccttctatagaattatagcatttatcaagttcattattaatagacatttggttgtttccagtccatttcctgctacaaatgatgctgcattgaatatcatgcatttcacacgtgaggggtatatctgtatattaaattgtcagaaatgaaattgatggctcaaaggatatatgtatgtaattttaatagattctgtcaaattgcttcccatagaggttgtgccatttgcatgcccagtagtaatgcaagagaatgcctgtttcacctcaacgttgccaacacaaaatgaaagtttgaacattctaacctgatggataaaagaacagtacatcagtatagttttaatttgtatttttcttataagtgaggttaagcacctttatgtatgtttgagtcatttgtatttctttttctgtgaaccatttctagcctttgctacattttgttgtttaccttttcttattaatttcttttactttttttttttttttttaaagtttcgctcttgtgtcccaggctggagtgcaatggtgtgatctcagctcattgcaacctccgcctcccaggttcaagcgattctcctgcctcagcctccagagtagctgggattacaggcatgtgtcaccacgcctggctaattctgtatttttagtagaggtggggtttctccatgttggtcagagtggtctctaactcccgaccttgggtgatctacccgcctcagcctcccaaagtgctgggattacaggcatgagccaccacacccagccttttcttattaatttctaggagtttgtacaatagggaaattttttctttgtttctttgtataaattgaaaatattttaccactttttcatttgtcttttaacattgccttcttgtcatgtaggtgtttttctttgaattcatgcatctttttatggcttctagattttgagtcatagctagaaaggttttgcagcttggtggttaaagagggctataggtaacataagagaagagacttgtatgacagagtatgaggaaaagaaagaagcacagttagataagcttaggtctagcttaggataatacttgaatacagcagcaacttttacataaattcactagtcttcatttctgcaacacttaatctgtgttttatatttcttctgacttctgatgttccaaacctatttacttgtatttcatctacaatttttgccctcagtatctctctaaagagtctttttaatgattatttcttaatcagaagatattggagaactatttcataatttaaaaaattaaattagaggcaagagggactgttattgaataaagggacctacgactcataaccacattttaccttgctcagatctcaattcaaacaaaccaacggtaaaatagcatttgggggacagtggctgtattttgaatgtggactagatatttatattaaggcattattattgttaaatgagataatggcatggtgattatgtgttacgttatttaaacagactttatcagttagagatgccttacaaagcacttatcaatgaaatgttatgaggtgggattttctttaagacattctaggaaaaaagtggtaatggtagggtatagggtatagatataaccatatggatcaaatattattgaagctagatgataaatacatggggttcattctcttctttctacattttgtgtatatgtttgaaaatgttcatagtgaaaagtttaaaatgactaagtataaaattaagaaatagttattataggaaactttaaaaaatagagaaaagctcaaagaaaaaaatgatctcaccagccagacatatctactgttaacatttcgttttataccattctagtcttttcccatgtgcaaatatatattatacatacacgttttattttattttatttcttttaaaaaggattattggccgggcgcagtggctcacgcctgtaatcctagcactttgggaggccgaggcaggcagattgcctgagctcaggagttcgagaccagcctgagcaacaacggtgaaaccccgtctctactaaaatacaaaaacttagctgggcgtggcagtgtgcacctgtagtcccagctactcgggaagctgaggcaggagaatcgcttgaacccagaggtggaggttgcggtgagctgagattgcaccactgcactccagcctgggcaacagagcgagactccatttccaaaagaaaaaaaaaaaaagattattgaggtcattcagtatgtaaattttgtaacttggtatattaacctttccggtgtatcatgaattatgtcctcaacattattgtggtttcacagcatttcagtatatagatacatcacaatttatttaactgtttcactgttattgggcttttagggtgttccttgtttttttcacccctgtgaacatcagcatccttgtgagtaaatgactgttcatgtctagaaatagttctttaggcctcactccgagaaggagaatcattagatcagaggatgtgtacaatgtacaatttaatacaagctgtaagttacccttcagaaggtggtgtcacagtatccctgcacccgcagtaaatgggagtgcttagttttctgcatttgcaaagccaggagctagaagacgatttgttcagacagatatatatatatatatacatatatatatatatatacacacacacacacacatataaatatatataaatatatatacacatatgtaaatacacacacacacacacatatatatgtgtatatatatatatatatatatttttttttttttgagacaagagtctcgctctgtcacccaggctggatgcaatggcgtgatctctctcggttcactgcaacctccgcctcctgggttcaagcaattctcgtgcctcagcctcccgagtagctgggatatttattagagacaggtttcaccatgttggccaggctggtctcgaacttctggccccaagcgatccgcccacctcagcctcccaaagtgctgggattacaggcgtgagccaccacgcccggcctgttcagaccaataattaacacaccagagtgatgaagtgtaattgtcgcacaaaggcatctctgattctgatcgtggatgaattattgccagtgtggtagggacaggcagggtcagttgcactgggcatctgcatggccacatatggctgtgttttatcagtgaaggagctgtgggcttaaggagaatcccagtgtctctggcccagcagcctatggcttctgattaataatatatattgagccggttattctctagtttttacagtgtcacggctcttggacagtttccataggtggtttggcatgcatttcggtgtggtggtttctcaatttctgcattcttgtaggtaagttcaccaggaagggctgctttgacatcatctttgaagactaacttatcatccagcactctgagccttgtgtcagtactttttggtttttcttgatattgtagtttgacaatcttgtttgttgcaaaatctgtagtgtgtttaaattttgagtctttcatacagcagttgcttaacattcatccaggaactgccaatttgtatttttgtctatgttcagattccatattattgccttgttctgtcccatcagtcagtaatatctgaggcaatcaaaggacagaatcctcatattagttctttgtctaaaggactctaacttttgtactgaacttttctttagaatcgtggttcaagtatagagtttaatgtagtcaaacagaaaagacaactgagcagcaaatcagcaaacaataaacctagaaaatgaaaaaatatttcccttgacacagccccctttaacacagaaaatgtagtattaaaaatataataaaatgattctcagtattctttttagggaaatttgatactaatgaaacaactttgaatgaaaaaatataaattacccttgacacagccccctataacacagaaaatgtagtattaaaatatgataaaatgattctcagtgttctttttagggaaattccatcctaataaaaacacctttgaacataattgcctttgtatgattttctgtgaatcagactttcgtcagtttgacaaacttccctaaaaagtatctgaaatctgccatcttctcagaatagtcagacacagcttagaccatgggtttcctgtctagctcatgaacatttgtaaaagtgaactaagtgactacaagcaacctcctcccaactagttatttgttataggaggactatatttgttatagtaggactacctccttgtcaaaacttaaaatgcataggagccctgaaattggcgctatcatccatcttacattagtaatcattatatgaatatagtgatgatttttttcctttttaaaatataaatttgtctgaaggtctcttgtcatcactttgacataagagctgtaaatcactctggagtagagatggttggagaatagaaggctatagttggttgatgaaaatcttgactcaacagtttgtgtcatagtttggggtaagccaccgtggcagtttgcagaggcggtgtggcagcggggagtgcctatttttaatcactgctgttccagggccaaccataattagggatgtttcccttgctcagtgaagctatattttgctttttgttcattgattgatggaaattgtaggacactgagaaaataaagatgggctaagagggttttgtcgctttttattcctccctcaattagggcttttccggggctgcataacaaagtgccaaaactgagtggcttaaaacagcagaaacatactgtctcactgttctagaggctggaagcccaaagtcaaggtctcagcagtgtgagttccctctggggctatgcaggagaatccgttccaggactctccctgagctgctggtggatgctggcaatctttggggttccttggcttgtagatgcatcatcccagtctctgtcgtcacgttcacctgctgtttgctgtatgtgtgtgtctatgtgtccaaaagtcccctttctataaggacagcattcatactggaccagggcccactccagtaacttcattttaacttgattacctatgtaaagatgctatccaaaaaagtcccattctgagtgaggtgctggggccccatcttttttgtggggacaaaattcaacctataacatccccattaaatatagtgacaaacagtcctcacagtgctcctgcgctccactggggggcaggattctccactgttgaaatggcccagggcttcggtgctgccttctgggttctggggtctggggttggccagcagggccagccacagccaggctctgtgacccgagctggtggagcgggcagagaagagattctgatgctttttatttctttattattatacttgatgcagaaattatgagccctgatgacatccaataataattgttttcccttatttgagacatttggggtaagctccgtattcttccataacaacaaagcaagcaggcaagcgtgagttctctaaacaaagagcggctttaagcagggaattttaggcttccaagctggcccttctcacaggaagcagccattctctgggaagtggcacccagtctccggcgtaccttgctcaagaacaatagacattagtcatagtctgttaattctgtctgtttcccatgagaaaaagaatgtgttccatggtgttgtcagggagtttcaggcccatgtttgaacttttcctaaggatcttctgtaacatcaaaggaggtgacctaagcaacctccaaatggggatctttggagtatgtcagggcctttgcccctgagtgttacagccccttgaggtgggcggagggtaggagtggtagcagagctgtgaccagggctgttctcactgtgtgtgtgtgtgtgtgtgtgtgtgtgtttttctgcaggcaccagttggagatgccaggacattactctcatctggctgccttctatgaggacaaaaagggggtgctccatgctggtcccggcagaggcagcagcctgccccctgtctactggctgccttccatccaccgatacatgtaccctgagatgaaggtgaggttagccctgcttttcttacactatactggatctgtatctgggaatagtagctgttgattactttttaatgaataaaaaatttatgtctttggatcatacaaaatgtctacttttgatagaacagagttgcaacataagcatttggtttttttaaaacataaggcaagttatcttaaacaatatgctttctagacacttctgtaatcatagtataaaggcgtgtgtgataggccagttgtgaaaagatagatttaattctgttgattgcttctgatattttaacactagacatttgaactaaagatgaagagtctgatgaagaagtatgacatttcttagttaagacacttctgatgttacttcgttctgtatttgttcctgaagtactttggctttggtactagaatatgcctatttacagttagcaaaacacccagcaaagcgttaggtgttggaagggtgcaaatatgactaagaacatgaatctcctctttctcttccctctctgtctcctgtggttggtcacaggatatttccatggaaacctagggctcccctggtagagaaattatgccaagagtccaagggagaactctgggaagatgccttaggagaggacgcagtccctgagtatttggctaggtggaaagtgaggaatgctgattccagaaccaggaaaggtgtgagcagcagtgagaaccatggtctgtcactttctcagcaccttctgggagttatgcattgtgccagctatttatctgtacctgttgcagcattctctaaaataaaagtaaatgttttttgtttttttttttttattccttgttttccagcgaaaacaaccgaggcttataaagggctagtgacttgctttaggtcttatagctaataggagttagagctaagatttaaacagaggtctagtgccacagccagtgcatgtttcctgccccacttcattgcctttgcagagatgtggacacggaaaaatgcaagacaagttcatgagacatgagcaaactagtttggctgggattaaatgtttgtcagctggcatgagggaagtgattggagaaataggctgaaattagattgtagagagctttaaatagtagaccctggagcttgaatcctaataagtaccaattaggggcttaccgggtaaagagaccatgtaggtatttcaaactaatttaagacaggaaatcagtaatataggagttggaaggctgaaggagtaaaaaaggaataggtaacccatatttagtaattatagataatagcctgactaacaccctatattagtgatttattgctgtggaacaaatccccaaattaatggtttaaaacagtacatatttattatttcacagcttctgtaagtcaggaatcccagcatggcttaaccagattctctatgtcacaatctctcatgagatggtttcagccagggttaggggctcatctgaaggtttgactggggaggtatccacctctaagatcaggtgggtgttggcaggatcgaatttcttgagggatgttttgaactgaaggcctcagtaccttgctggctgttagttgggggctcccctcagttcttagccatgtgggtctctccactatgtgagcttgctttatctaagccagtaagagagtatactagcaggatggaagtcagaaccctttgtaacctaaccatggaagtgacagccctgcaatgtcaccatattttcttagaagcaaattactcaagagcaagaggggattgcataaggctgtaaataccaagaggtggggatcactggggactatcttagaggctgcctgccacccttccttagggctagggtaacaaagcaagagaagcagaatgagcaaaaccatgggagcctgcaggaggggtccctgcacagccagtgctcagatcgctgagggaggcactgcgcatctgtgctgggacctctcaggaggtgtggctccacgtgtgctgtgcatgctaaggaaagctggaggctggagtcataggtgtcttctgctcctggagaaatactagctggagcaagaaacagaagagatttccttctgcctttcaatctacagtccatgctctccattgaagaactctaacaggaagccaattggcgtatgagtttaggaattgtcatttgcaggtttcccaaccccgtggcgtaggctgagagacaatcattaagaaatcgttagagggccattagaggtactctgggcttgcactgacctgagtcctgttctctttctgtctgctcataacttagacccattttttccttcagagtccaatttctgttggaattatctccaaatccacagggaggtgaccagcatctgacctaaatgtactcgtattcttccccataagagtccagggatgagggactaagagagaaaaaagaaaatggcccatgcttttgaggacagctcattaacataactgttagaccctaggagatgcagggaagagggtaccgttatggttgcagatacaaataacagtggagtgtcttctttttacaaaacaatatgtcagcacatcaaaataaaaaacggccaggcatggtggctcacgcctgtaatcccaacactttgggaggccaaggcgggcagatcacttgaggtcgagagtttgagaccagcctggccaacatggtgaaaccccatctctactaaaaatacaaaaattagctaggcttggtggtgggtgcctataatcccacatacttgggaggctgaggcaggagaactgcttgaacccgggaggcagaagttgcagtgagccaacatcgcaccactgcactccaacctgggcaacagagtgagacttctctaaataaataaataaataaaacatgtgccttttgtttcagcaaccttactcctcaggatctatccatcagaatgacgtatgtgtaacaatatttaattcaacattgttcacagtggtagaaaactagaaagccatagtgagtagtgaattagagcataagaaggtgacatggaaggatcaccagatctcatttgtgtgagaatagcaacgtgcagaaaactcatcattccttggtatttgcagggccttggttctaggcaccctccctcagatacccaaatctgcagatgctcacgttcccatgtagtagggtgtagtatgtgcatataacctatgcagttcctcccatatacagatactcctcaacttactgtggggttacacccccataagcctattgtaagttgaaaacattgtaagtcaaaagtgcatttaatgctggcaacccagccaacagtccttgacttacgacgggtccacttaatgtatgatttttcgaccttatgatggtgcggaagcaattcacattcagtagaagccataatcccatcaaagtcttaaggagcttcttgacttaacgtggggctacatcctaataaacccatcatacagttgaaaacttggtgagttgaatcatggtaaatcagggaccttctgtgctttaaatcatttctaggttacttataatacctcatacaatggaaatgctacgcacatagttgttatactatgttggtttttacatgtattaaattttcttattgttattctttattcttccaaatatttttgatctgcatgcagttggttgaatctgagaatatggtattaggggatacagagggccagccgactgtacatgtgatatgattacactgttgttaaacaatcacagtgtctgtctagatagagacacacacacacccagacataaacatggaaagtattgatgggtgtatatgagcttattaagttatgtattccctggatgaggtaaagtatgggatgcggtagggcaaggcttacatgtacaaaaaaggcagggaccaggaaaaaaaaatgacagtacttaaaaatagcatgtatgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaatagcatgtatgatataataatacttgtcatggatggaaaataatgtaatatatctgtcagtttttattgaaatataacattttataggaataagttcaaaaatagtatatatgatacaatacttgtcatgtatggaaaataatatatatatatctttaagctttttattgaaatataaaactttatagaaataagttcaaaaatcatacgtatataattcaatgaatttttacaacatgaacacacgtataaagaaaagctttagtctgagcacggcggctcatgcctgtaatcccagcactttgggaggccaaggcaggtggatcatgagatcaggaattcaaaaccagcctagccaacatggtgaaaccccatctctactaaaaatggaaaaattagccaggcatggtagcatgcgcctgtaatcccagctacttgggaggctgaggcaggataattgcatgaacccaggaggcggaggttgcagtgagctgagatagcgccactgcactccagcctgggccacacagggcaagactccctctcaaaaaaaaaaaaaaaaaaactttaaagaagtaagcttttaatgtaggagtcagatataggaatgtttcagagggaaaaaaataaactggaaaggaagcagagggaagaggaagacctctctgagaggtccagatgtggctgctaaatgctccccttaggaaaatgggggagtgggagagggatacaggggaggggggctgggccccgggagtggagggcttccctagtggcaggcatgggtctatcagagcctgctatggacactgaactgacagtggttagggagtaaaaagaaattggagtgaaaagaggatggagtatggacttgaaaggttggagggaaaacatgaaggtacgcactggagacatcaagaaaagagatttctctgtaaaagccagagaaacaaggctggaaaaagggaaagagatttcaatgaaagcaggaggaatttctgttgcatgtgcaggtgagaaggggtgagaagtctctagagctgacccttttagaagaaaggaggtggccctgtgggcagtgcttccctggcatgggcctgggcacagggcctgaactacttgcaggtcccaagaagggccatgttgcctcttacctgcaggcctttgtatgtgaacaccttccctcagattcatctgtttttgtttgttgtttgtttgtttgttttgagacagtctcgcattgttgcccaggctggagggcagtggtgtgatctcaactgactgcaacctctgcctcccagattcaagcaattcttctgcctcagcctcccaagtagctgggattacaggcacgcgacaccacacccagctaattttttgtatttttagtagagatggggtttcaccatgttgaccaggctggtcttgaactcctgaccttgtgatccacccacctcggcctcccaaagtgctgggattacaggcatgagtcacagcacccggcctcagattcatctttatgtcgaagcttcaacatcacttcccccaggaagtcttttctgtctctcctagagtgggatcaggcaccctccagtttgctccaccatgccccattcttctcccatcatggctctgtcaggctatattttaatcgctttctcccactagcctataaaatatacattgggcaagccccacctggcctctgtgtggtggaagaacaagttgggagcttgaagataaccagtgggaaagctgggaggaaccggcacgtgctttggcaccctttcctatctggttgctgttagactttgaagagaaatagcgattggagggatgcaaccagccttggtcacttggtgcctctcctcctcatgatttgggttgcggtggcagaggagtaggcgtgggtggcaaacaggacatgttcagttcagggtcgcctttatcctggcatggggtaggggaatggtatcagtgcaggagtgatgccttggaaagggaaatcctctccgggtagtgcagacacagcttcggagggtccaggacagccctggcttggacaggcagagtgcagaggctgccctgaggctcgggtataggtgcctctgaaggctggtggttgttaaaccctagcacgcagcccgagagtcggtgcctctctcagaagtgctcttgcctgcctccctgatgggtgatgagctctttcttctggcactttggcatggaaatgacctttcacaaagctcacaaggcccagggtttgaagcctttctgtttttcaaagcaacagtagtggccaccccatattggctatttttatgtgctatttcatgttttgtctcaggcggtccttaaagtaaccctacgaggtaggtgatgattccgtatttcacagttaaggatagtgaaccggaaacattagctaactttccccagatctccctgttagtaaatggcagggccaggattggaattcagctcttcctgggatcagagcttatgctcttaacccctatgatactccttggctcagtgttcctagaaggcaattcaggggttgccagttagtgacagaaggaagagtggggccagtcgtggtggctcacgcctgtaatcccagcactttgggaggccaaggtgggcgaatcagttgaggtcaggagttcaaagccagcctggccaacatggtgaaaccctgtctgtactaaaaatacaaaaattagccgggcatggtggtgcatgcctgtaattccagctacttgggaggctgaggtaggaaaatcaaacccaggaggtagaggttgcagtgagccaagatcacgccacagcactccaacctgggtgacagagtgagtcagactccatctcaaaaaaagaaggaagagtggtcagaggtgaagtgcagcaggggttatgccaggggctccttcctacctgtgacttctgcagacacctcactttgcacagtagcagcccccatagatttgggatctgactggggactgtttgctcatcatgttattacttaacagtgcttagtaatgttttcgagttgagttttcttattgaagcagatgcttttattctggtttttttaaatttaaatttagctttgtttcctttgcattgttctcctgagtaaaataatgatcactcaactcaaacatcagtgtatcagggagctgttgtattatagaaatccagtttaaaggtaagacttttaaagtgaaaaacatcattgtgtgtggaaataagcatcctttaatgtatctgtttggatggactttagaatttcagagaaggagattagataccttttgctatatttctaagaagctgttcctcactctttctcctccctattcccctcaattttttcagatcacacacccagctggctgcatgtctcagtttataaagttctttggagaacagatcctcatcctctggaaatttgccttacttcgaaagcgcattttgatattttctcccccacctgtgggcgtggtgtgctatagaggtaaccagaagccagagtcaggagtgctgcttaaatccctggagcagaaactgcttgagtctttctgtcactgaccaagtttggaagagcttgggccacatccaggggatggggttttaagcccgggagtgaactgattggctgtgaacactgttgacaatgtagaagatgggttggatgacacatcagtggcctggccaaagattagggctggattaaagcagagaagatgcattctagatggatttaagagaaactggacaaaacttgttgtctgattgggttgtaaaggttctgatgtgtgtgaggttgcagtggaagcagagtctaggataacaagggtggtggggccaccagatgggggacggaggaggagccgggggctggcttgataaggttagtgtgggatgtgatgagggtgtgctgccttgagaccttcacagcaggggtgtctgcccaccctgcctagctgggtcgggacctgtgggcgtttgagctggagataaagatttgagggtggtagattatttctgcactcatatccaggatggacagcgttacctggggaaagtacaagtgtggaggggtgttccaggcacaggaagtggaccagaaaggtggaaggacagaaaggactagggagggacaggcagaagggggaaccggaagacacaagggttacagaggccggagttctgacaaggtcaaattctaagcaagaccagctagagaaagactgagaaatgtttattgggtttgggaagcacgttgttgacgtcaccttgaggggtcagtttctgccatggcaccccaaaaggcttgccacctccagtctcctcagaacgccaggaccacctggatcctgaagcaccagatagcctggagcagaggtgttgagccgcaggctccgagggaggaagggctgtggaggggcagaccctccccgctcacctcctctatccccacagtgtactgctgctgctgcttggccaacgtttcactgcctggcatcgggggcaccattcctgagtccaaacctttcttctacgtgaacgtggctgacatcgagagcctggaggtagaggtgtcctatgtggcctgtgagtacggggccctcccctcatcttgccctcaggtcccagccctgctcctcccagacacagggctcctgggcgccttgtttcccagtggggtcgggtgggttcccacctctctaaccccgggttccacaggcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggtagtggcagctaaggggagaaccaggggctccaccctcctcagggcagctccagcatgggggtctctgcaaagcctgtcttctgccccttccctgacacatttctcccagtctccatgctgcctgggatggagatggaaatgaagggaagccccgcagtagaagaggccaggctccctgtatgctgccctgataggaggggagtagatccacggtgctggtttatttcttctcatggactttggaatctgtggaaattaccttagctgccagctgctctccacgtgacctttagatgtacctgtgtgtgcggcttagaagcaccttgactgagcaccttcattgtgttggtcgccgtattagaagcttgcttatatgtatctgatgtcattgtcaataatctggtgatcctgtgaaataagtatcatcatcatcatcatccccttctgatagacaactaggagattgttacttgcctaagattaccaggggcagaactggccctggaccccagggattttgagtccaaaccctgttgatccctttcctggctggtgctgcttcctgggaggtggtggcccattgaagatgcctggctgaggcctcacctgtgactgcggtcctggtacctgcaccagagtctcacggtgatcttcccaacaggcagatgctgttgtactcccaggaagtagaagaagactacaacccttgtgaagaggacctcttcgtgctgtgagtcctggggccgtggatgtggagtctccctgaggatcccttcggcactgagtgacctgcatccctcccatgtcattcactgcgggccagggatgccgtttattgctgccaagggcacttagagccgggctccttacagaggcaaacctgagccctgaaatgccattagggggaacccagaagacttagggaaagaagcaggtcccttaagagaaaacaggagtcttagtgtttctttccttgttgggcttttacatcgaggatgtccactgcctggaagctctgtctgtccctcaggactcagggacttctcatttccattgcctcctttgaatagagtagttccttgcgctgaatattatgggataatctgaaattttaattcttgaatcaaatgaaatctctttgccccgtaggtgcagaagccagggcctttccacctcacagtactgatttcattcctagacagctgggtgaagtagccttctgtggcatcaactgaattctcccagcttcctgtttggtcttccaggggtgaggttgtggtttgatgctgaaaacttaatgtgggcatttctacaaaggtgtagcaccttgattctaatagtggacttctaaaacctacatcctgtttaggtggaaagtatctgagacttgagcacagccatagtctcatccaggtatgacatgtgccactgtgtctgaaattcctgagcaccgagggccgcttcaggcaccaggcactttgccaacctgagagctgtatggggctggactgtctagtctaactaggcagtgaaccctgtcctgaacagagcttgtttgttcataaagcactctaaagcagtgacttttaaatcttgatctgtgcataatctcactcctcccaaagagtcatcaagggagagcaaacacccaagggtaacgttggctcacgttcattttgttgttgttgttgaatttttgcttcctcctatgactaagcagaaagagagaaaagcagtgtttgggggcctcttctcaggctgtgtttaaacccaggtcacttccctcaacaggaaaatggattttgacaggccatcttgcttagagatttccctaatcacaccataattaatgccaaatggtttctttgctaaccttagtagcacttgaataattaacttttactcttttctttttttaaaagatacctgcgaatccactgaaaagtacattaaacaaaacagtatagttttggttccccatatgtggattatctggtgagctttttattcccccccgcttcctttcctgtgtcttgtcttccaaatgcaggtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccacttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcttcttgcctctcaagggttgaggggtcctttctgtcaagtaatggttatttttcgtggtatcctgaggttcagggtgttttaagctgggggtaggtggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaa

SEQ ID NO: 831 - DNA, 3450 bp, Homo sapiens
cggcgtcgactgcgtgcaaaacaaccgccgccaacgcaactccacacctcccagacccacacgtcaaagaacgcgaaccccgcggccccaacttctggcctctccgctccggcgcctgcagccccgcggggaaggggcgacgcgagggggcgcagggacagccccgcacctgggaggcccgagggggcgcccgggagggaggggctgcaaacggcggcgagcgcgcgcggcaaccgccaaacgcccgcctttgtagccccggccccgcgtccttaccctgccgacggctgctcggctccggcccgcggcggcggccccagagccgaggaccggggtgggctcgcgctcttcgtcactggagaagtccgggggccccttgctgttggtgccggcggggagcggcggccggttgcgagccgtgaggtgctgcaggtagagctggacgtacacgtctttgcgctgctccccggccggcagcgtcacattgttggcgaccaactcactcttcaacttgtcttttgtcaggaccgaggggtcttccaggaactccggcatctcggggatctgcgaagccccctccccacagcctttgccgccgccgctcacgccggcgcgcttgctcctggccggggaccgcgctgccgcctccgagcctcacggctcctgcccgggaagagcgctgcggagcggaacaaaaactcgcggacacaaagccaagccagacccggacacaaaagaccccagagccgaactacgaaccaactgcggccaagctggaagctcgcaccaaccccagcccacacactacaggcaggaggcgagcagcctgcttcgcccacgccccaagaacgcgcgccgccattggcgggcgacgggaggaagcgcggcggtgattggcgagacggctcgcgcgggttccattagccgccgcgctgagcgagaggaggtagaaacgcagtttaaaaggcgctggggcgggagccgaggctcccggcccgcttctgttttcgttttctccacccttccccttagacgccgataagggacaggtcgtactgcttttgtgcgccgtttcctctccctcccccagcttgagaagcagctttcgtctctggggtcgatcgcctacgaacgcgccgaattccacgccagtgtgaggacccttggctgggcctttcttcctcccgggacactgaagctccaagagtagccgcagccttgccttccccaaacgctagccctgaaggggaagaaaagaagcgaggcttgtctgcaggcactcatattccttgatttgatttactttgggagggggagggcggggagttacccctctcctcgcgaacgcttcttttgttccagaaacccaggggaagccagacctctacaatcgggcacttaaattacccttgaatttgtgacaaaagtgtactataccattcacttcttagtgtcatagttggggcatgtctaaattgtttaatttgaacagtgcgttcagacgcaagacaaattcgcgcttgcatttttgttgaaaccgtctctggctttggatcccaccacccgcaagaatcctaaacctaacgtttgataacaaaacgaaggagaacccttgggaaccccctcaatggtcaatttaaaataacagatggtgcataatcctaaaggaagactagtgacctataattaggcctagaaccctaatcaaacccgtattaccgatccaaattaaaacctggtagaatctaatacattgactgcaattaaaatgtttgcctggaaattagtatcactgatgacaaatatttgtatttctgatgaatatgtatgtttaaagatgctttctttctagaaaggaaaggagaccttggatgtagggtgtgttaatcatttccccagaatctgagctccaaactatgttttagaaactggttaaattttttttaaatgtttgcctgctttctacattgctaggttagaatacatttaaaacaaacgccttcactaaaaatgtttcctatgatttaagcgacttacttttattcaaattgcgatattatttcttttagtgataattattttcctagaggtaactaattcctttataaaaatctcagtattcacatacatttaagcaatggtattaagctcaataatgcaaattaaaaatcaggttttaattagcaagttgttaggtaggtttttatgatcccttgtaaaagttgcttggttttttgtcctcacagcttccctggacacataggcaaatgtttttatcttcagaaggggaactgagctgagaggcaaaggaccatgactttgcaatgactggtaacccagtacgtataatgcaagaactgcattctagatacgcctgaaattaatgtttcctgggcaaaaacattttcattatcttttttttaatccctggacattagctacaggtggttacttgcagatttactgctgtagagctccaaaattgagattacacttttcagattctgcgtaccctaaggctaagaggttgggctattgagtttgggtggtctctttggtcctgattgctacttccaaaccatttctgctcttttctgcttcaaaaatatttgaagttcatatcttctggctaaatcactttctactctccttcctgccatcatccacgagcctcctggtcactttccagaaattatagagctgcttgccgtaggttttcctcaccatccctcttgtctacattctatctgaattcagcatgcttgtaggtgacccatgcaacaccaacacttggcctcttagacctctgacctcttcatctccaacaatttgttcctctcttgcgtcttaaccacttcggtatcagtcagattctgaaccttgtcatcagttgaaatctcagtttcaagcttcccaattgtcaatcactagcctttttttcccagctaatttatggtactctcacttacctaattaagacctccacgctattaaccccaacacttaaaaaaactcaactcttctgcttctgccatcatgtaataattttgcaactcacctgacttaaattccctgatcagtccttttcatcactcttttacaaacattttcaactctctgatctcaatgtctccttttttgcttgaaagaatctcagccttgcttggactaaaccatgctccagctgaactttctcattgcttacatccaaacagcaaaagctgctggagaaaagtcagtcatataacaagctaactggttttaattcatgacctcagtcctctcaggagcactcaacactggctggcaatgctattccagtctctgggttaaccattcatacgttcacatctcctcaaatttcacatcctttttccctacctctcatttttagctggtgaccttgcctcaacttcaaaaaataaaaaccacctatgaggaatgcttcaa

SEQ ID NO: 832 - DNA, 20088 bp, Homo sapiens
ttttgatgttaatgactttactttgagatatgatggaaaaatattacaggtacacatggaaaagacatgatcaccaagtgaaaacaatctaaccagaaagctttaacgtctgtcagttaagctgaagctgaaattctgggagcatgacatgctgcagggccaaaaggaatggataattagtattcctctccttcttcctcaccctctccttcaacagaatccacaccaacctcctcataatccttctcaagggcagccatatcttcacgggcctctgaaaactcgccttcctccatcccctcacccacgtaccagtgaacaaaggcacgcttggcatacatcaggtcaaacttgtggtccaggcgagcccaggcctcagcaatggctgtggtgttgctcagcatgcacacagctctctgtaccttggccaggtctccaccaggcaccacagtgggaggctggtagttgatgccaaccttgaagccagtggggcaccaatccacaaactggatgctgcgcttggttttgatggtggcaatggcagcattgacatctttgggaaccacgtcaccacggtacaacaggcagcaagccatgtatttaccatggcgagggtcacatttcaccatctggttggctggctcaaagcaagcattggtgatctctgctacagaaagctgttcatggtaggctttctcagcagagatgacaggggcatatgtggccagagggaagtggatgcgggggtagggcaccaggttggtctggaattctgtcaggtcaacattcagggctccatcaaatctcagggaagcagtgatggaggacacaatctggctaataaggcggttaaggttagtgtaggttgggcgctcgatatcgaggtttctacgacagatgtcatagatggcctcattgtctaccatgaaggcacaatcagagtgctccagggtggtgtgggtggtgaggatggagttgtagggctcaactacagctgtggaaacctggggtgctgggtaaatggagaactccagcttggacttcttgccataatcaactgagagacgttccatgagcagggaggtgaacccagaaccagttcccccaccaaagctgtggaaaaccaagaagccctgaagaccggtgcactggtcagcctgtaggggaataaaaaaatgtaatattttaatgccaggacacattatcttagaatttctatttcaactttttagattacgaaccatatctcactgatgtaagcacaaggaattggcaaaacagacatatccacaaactgtccataacctagggactatctgatttagaagtccaattaatatagcaagcagcctattccacattttggtaggtgccaaagaatgaatgatgtcagtcactccacccaacttgcactggaactatcacaccacattaaatgcatatttatatgtggtgcttaccagcttgcgaattcggtccaacacaaggtcaatgatctccttgccaatggtgtagtgccctcgggcatagttattggcagcatcttccttgcctgtgatgagctgctcagggtggaagagctggcggtaggtgccagtgcgaacttcatctggaggagggagagaaggacggagggagtgagtgagtgacaagagaagcccctggacagacctcctgtcccagcatcctgggatctcaggttactgaggtcaactcaccaatgactgtgggttccaagtctacaaacacagcccggggcacgtgcttgccagcgcccgtctcactgaagaaggtgttgaaggagtcatctcctcccccaatggtcttgtcacttggcatctggccatcgggctggatgccgtgttccaggcagtagagctcccagcaggcattgccaatctggacaccagcctggccaacgtggatggagatgcactcacgctgcgggaaggaaaaaagatatcacaatttaaaccaatctattgatgactgtcaagtggaacaaaatactcatgcaatctttatttttttagagataaggtctgtcgcccaggcttgagtgcagtgatgccatctaggctcactgcagcctaggctccagtcatccccccacctcagcctctggagcagctgggaccacaggcacagaccaccaagctggctaattttttcattttttttgtggagatgaggtctggctgtgttacctaggctactcacgtaatctgaaaacgaatttccttttctaaagcgatcttttctaaagatccttttctaagatgtactacttttgagaacagctacactatagtctacgttgcttttaatgaatgttaccttcccatcctaaaccgggaaggcctccttccagaccaagacagctcagtcacagcttcctcctttggaggaccaagacaggaaggtgggcatccatccagcgctcaggccccagaagcccactttagactaggtggtcacatttccgggcagctcctagcacaggaagcacgtggccagaccagcgcagaagaaatgtctgtccgcagggacaaggggcggggctctgcggcacaggatgaatgagcaattccgggcgcgcgctcttgcgccccccggcggtgctgcagaggcacgaaatggccacgtctgcaaaggcgctgcccaagccgcccatcctcccttgcctgccggcatcgggctcagcctaacacctccacagcagtctgagcgcagtaggagattatcggcggcccagatctgggtcaagatccgatttccgttccctcaaaatcccttactgccaccacctgctcccctgaattcctaacgcagcagggagagacaggtggcctctacagactgttgtgtacgaactgtcgtaatacactggtgtagagcggtacattgacagggagctcttccgcagtcctcttattgctttcatcaaaaaaagaacactcaggttaacaggagacacgccctgtagccctagtcgcgtcgcgacccagagcgcatgcgcaaagcgcagtggcggtttcccgcccaggagcggcgggaaggtaacggtcgcgcgtgcgcgcttttgtctccagctgcttcccacccccgcttttcgcgctcaagaggaagtgagggctggaagagtccgcgcgcgcgtccacccaaggcggagtaagggcatgcgctggaaaggactgcggggactcgagggaccgcacccaggacacagttacgcgacaaaagagagctccggatacggcggagggcagcccgagccccccatcccttccagagtccgagaagaaatcctggcgcccctcgacctttccgggcccccgctatttacacacaccgaggtctcaccactcccgccctggcctctcgcctcgttttccgccctccaaacggacggctctgaggccagcccttcccggctgtatacagggccccagcgccccgccggctcgcttttccctgcttccctgaaagcagccgggagccgcacggcttactcaccatagtggctagggattaggaggcgaaggcgacaggagcagacaccgggtcccggttaccgtccccgacaagctaagagtcgaggtaagtaacgcactagggcggggccggcgctggagcctcttaagtagcggctgcggaggggcgggcgggcacaggcggtgccgcggtcgctggcccctcctccggccccgcgcgcccactccgcgcccggcctggccgccgcagaggcgggctccgagccccgagccccctcccctcgcgcggccgcggggtggggtctgccgcgcctgcgggcaacgcgcgccagtactgcagtgtgcggcgcatggctgcgagggcctgccgaggggcgggcgcgagtcggaaagacaccgaccagggaatgggcgacgaggcttgccttaattcggaggaaacccaggacttgagagagccatacaatttgaaagacgaagcaccgtgaaatgcagaaagttgtggttcggatagctcagctgattaatttcatgttgccacagtttgtcagtgagttttgcctttttattttctcagttcctttaaaggcagtgcattcggtacttacctgataatgtgaaaaacgcgagctttagaaaaccgaataggtgtacatggtttactgtaatgacttgttctccaaagtaagagtaccaaacgctggaagcaaatagtatttcagtcattcgaagagtagtgcccaagcatttaacattgaagctgttaaaagggcaaagtaggccccaattttagatctaagccatcaactttatggaacagtcctaagggctttttgaaaaggagatttaaaaacacatttcagaggtggtagctgagttgaagaagtgaggaaagacttggatagggaggaaatagtttgacactgaaggatgttaggaagtagggattccttgtgcaacttaagagttttgtaaataagacggcttggccttgtgtcaagatacatcaattggttatagcttagtgcttggaggcccacattataggagtagactagttctccctccgccccgcccctggaaaatctatttcaagaccataaaccacattgctaatccttggaaatgcagaaggtggttaggtttaaaatgtggctttaaaatggtcctaacagaaacgtattgatgttactattcagaatatctgcccagtatacgaggaagaaaaaggttaaacctaaaacactaaaaattcatagttcatattcagttattagcctatgaagatttggtacagccttcatccttcattttagacaaataacaaatctatatggtttataagtgtattttgtaaggagttatatatatctatatatgtgtgtctccacccatctgaacctgacctgcaaaccaagaggttcttgtttatttccgatagttttggtagtcttgttaaaggcatttgattcaaaatccaaatttgcatacatttttccaactggatagaggaggcaggaatatatttgaatattgttctcacttattttgtccctcttcttattctttaaaaaaaaattaagcctgtcaattttagcagtgggggttgcatatcaattttagtgatactaatgttaataagttctgataacccactaccattggaccacccccactcttattcctaaaacgaatctgaaaataattagcttgctttaacgggaagaatgaatgttagggaaccaccctgctgaactccattttgctgtcggctctgaataaagctattttatccagaaaagctatctctggacaaatattttgaatagttcagtaaccgcaataggtttctgctagaaccattttgaagccaccctttaaccctaaccaccttatgtatttccaaggattggcgatgtagtttatggttttgggatagatttttctgggggaggggagaacctcccttctagctctctgcagattatcagagccgccactgcagggatttgctcccgtgggcctatatgtctccccagataccttcctaaaactattagcttttatctgtctgtgtattcccctgttgtgaatggggaagtatttgagggcttgtttttttaggttcttgataataaatacctcaggtttcacagagtaatcaaactaaaagaaaacttcttttttatttcattttatttttttgaccgaaactccatctccaaaaaaaaaaaagggtatattgttatgtgatattgggacatccgaacattttgttgtcataggagtttgtccttgccagcattaataaactgcttccttagctgtaaacatcttatgaccatgggttgtatctggtaaggaataggctttgctagtctaaatttagaattgattttgaaattgtgttatcctagcccttttttctttttttgagacacagttttgtttttgtcacccaggcaggggtgcaatggcgtgatcttggcgcactgcaacctctgcctcgtgggttcaagcgattctcctgtctcagcctcccaagtagcagagattacaggcacctgccacaatgcccagattatttttgtatttttagtagagaagggatttcacaatgttggccagactagtctcgaacttctgacctcaggtgatccgcccacctcggcctcccaaagtgctggaattacaggcgtgagccaccgtacgtggccatgttaccctaactcttatgttcctgtttccctaacataatacctcctttactcttctcctctactactctaatcttaaggggagatgaagggtgaaggtcattttttgtaacttcttcctgctgacagtggacgttgatctttgggacaggattctcttataagaatttgcagttggtgggctgggcacggtggctcatgcctgtaatcccagcactctgggaggctgaggcaggcggatcacgaagtcaggagatcgagaccatcctggctaacacggtgaaaccccatctctactaaaaatacaaaaaattagccaggtgtggtggtgggcacctgtagtcccagctactcgggaggccgaggcaggagaatggtgtgaacctgggaggcggagcttgcagtgaggcgagatcatgccactgcactccagcctgggcaacagagcgagactctgtctcaaaaaaaaaaaaaaaaaaagagaatttgcagttggtttctagggagccaggggaggtccatatttgcatgatgttctgtctgattttttttttttttttttttttttttttttttttgagagagagtgtttcactcttgttgcccaggctggagtgcaatggcacaattttggctcactgcaacctctgcctcccaagttcaagcgattctcctgcctcagcctcctgagtagctgggattacagacatgcgccaccacgcccagctaattttgtatttttagtagagacgggctttctccgtgttggtcaggctggtctccaactcccgacctcgggtgatccgcccaccttgggctcccaaagggctgggattacaggtgtgagccaccacacccagctgattctttttttttttttttttagatggtgtctcgctctgtcgccaggctggagtgcagtggcacaatctcagctcactgcaacctctgcctcccaggttcaagcaattatcctgcctcagcctcccgagcagctgagactgtaggcacgtgccaccgtgcccagctaatttttgtatttttagtagagatggggtttcaccgcgttggccaggatgatctcgttctcttgaccttgtgatccgcacacctggcgatgttctgatgattcaatgggcatagccctgcccagtattggaggagtaaaaaaaaaaaaaatatatatatatatttatatatatatttatttttatattatatatatttttatattttatatatatatatatatatatatatatttttttttttttttttttttttgtagagatggggtttttccatgttgcccaggctggtctcaaactcctggactcatgtaatctgcctgcctcggcctcccaaagtgctgggattacaggcatgagccaccacacccaactgtaacacatttttatgccagaataatattgaataatgataaatgtattttgcctctttttccttttctttttttctttttctttttctttctttttttttttttgagacagggtcttgctttgttgcacaggctggagtgcagtggcacaatctcagttcaccgaaacctctgccttgtgagttcaagcaattcctgtggctcagccccccaagtagctgggattacaggcatgtgccacgacacctggctattttttatatttttagcagagagggggttttgccgtgttgccccggctggtctcgaactcctggcctcaaatgatttgcccgcctcggcctcccaaagtgctaggattacaggcatgagccaccatgcccagcctgcctcctctttagtacctgacaggaaagtctgattttttaaaaaatccatacttaacctacataggtatatttgttttttgttttttgttttgagacggagtctcactctgctgcctaggctggagtgcagtggcgcgatctcagctcactgcaacctctgtctcccaggttcatgccattctcctgcctcagcctcccaagtagctgggactacaggcgcccgccaccatgcccggctgctaattttttgtatttttttagtaagacggggtttcaccatgttagccaggatggtctcgatctcctgacctcgtgatctgcccgcctcggcctcccaaagtgctgggattacaggcgtgagccaccgtgcccggccaggtctatttgttttgtttgtttgtttgagacagagtctcgctctgtctcctaggctggagtgcagtggcatgatcttggctcactgcaacctccatctcccaggtttaagtgattctcctgcctcagcctcccaagtgagtaactgggaaaacaggtacgcgccaccacgcccggctaattttacatctgtgtgtctgtctgtctgtctgtctgtctgtctatctatctatctatctatctatctattttttgagatggagttttgctcttcttgcccaggctggagtgcaatggtgcgtgatctcagctcactgcaacctctacctcctgggttcaagcgattctcctgcctcagcctcccaagtagctgggattacaggcatgcgccaccacgcccagcaattttttgtattttatttttagtagagacagggtttctccatgttggtcaggctggtctcgaactcccgacctcaggtgatccgcccacctcggcctcccaaagtgctgggattaaaggcatgagccactgcacccagcctattttttttatatatatttttagtagagatagggtttcaccatattggccaggctgttctcaaactcttgaccttgtgatctgcccgccttggcctcccaaagtgctaggagtacagatgtgaaccaccatgcccggcctctgttttttttttttttttttttgagacagagtcttgctgtattgccaaggctggagtgcagtggtgccatctcagctcattgcagcctccatctcccaggttcaagcgattctcccacctcagcctccttagtagctggaattacagatgtgcaccaccatcacctggctagtttttgtaatttagtagagatggggtttcacgatgttggccaggctggtctcaaactcttcacctcaagtgatccacccaccttggcctcccaaagtgctgggattaattataggcatgagccaccatgctcagcctctatttattatacatacctatacacacacacacacacacacacacacacacgagtaaatagtagttatctatgtctggaacataaacacagtagtatttactgtcttgacattttttttcctcccctaagacaggatctcactctgttgcctaggctggattacaggggcatgatcatggctcactgcagcctccacctcccaggctcaagcgatcctctcacctcagcctcctcagtagctgggactacaggcaagcaccactgtgcctggctaattttttatttttgtggaggtggagtctcattgttacccaggctggtcttgaactcctgggctcaatcgatcctcccaccttggcctcccaaactgctgagattgcagtacaggccactgtgcccagtctgtctgcacattttaattgattatataggcctttcttttgttgtactctttcaggcctgcaactgtttgctttgagtctttggtgtagtgggaaaccctgtgatgcaattagagttattctcatttttgctacatagtatcatggccatttgctactgttctaagcagtgggtaactgtttttgatagtttccatattgtggtttagacacagaaatttacaaaatattttgttcatttcactagctctacaagtaaaaacaaaataacaaatggcaacaatttaccaagtgttaactatttataaatatttgaacttcattcttatttatcccaatattataaatttacatctgcttttccacagatagatggtactggggaaagaaaattgactttgggctgggtgcagtggctcaggcctataatcacagcactttgggaggccgaggcgggtggatcacttgaggccagtagttagagatcagcctggccaacatggcgaaaccccgtctactaaaaatacaaaaattagttggccctggtggcacgtggctataatcccagctacttgggaagccaaggcacgagaatcgcttgaacccaggaggtggaggttgcagtgagcagagatcatgctactgcactccagcctgggtgacagagtgagactctatctcaaaaaaaaaaaaaaaaaaaaaccaaaaaaaaaagggaaaaaaatagaaaattgacttcggtggtgtcagataggactagattcaattctagctttgtcagttaatagtggtatgaccttagacccttaattatctttctcaagcttcatttatgaatgggaatcagtgttaacttggaatcacctttttctcatacattcagtcccattagttcatgttgtcaatttactttcaaaatatgcccactactttttatcacaccactcttatttcacagctcttacagaatctgaaattaccttgtttgtacatttatttacttgtttaaagtttcttcttttatgtaaactccatgtctctttttgtggaagtcagtcttggttgcccttccaaaaactaccttcttccattcctccttgctaagacagcctcctttatctgccactgtttaaagggtatttgtgtgctcagtccccggggacaaataaatgcaaccttgtttccctttgccagatacttgctttttcagtttccttcatgattggacctgattctgaccaatgggacataaagaggcaagtcagctgaggactttctgggaatgattttcttctctgataaaaagagattaccccgttgaggaagtcccttttgtttcacccctctccctttgctttctgcctttggaaatgttctttgaagatatgatgcctagagccaacttcagtccttgagggtctaatgcaaagagaatcataaagatgccagttcagtgcagtggtctgatattgtgaagctatcgacctaaccttaaaaccaacctatctccacatttattaattaaataataaattaaagaaactaaataaatattaatgaataaaggaaacagtaaatgtccttataatgtaagccaatgcaagcaggctttatccctagagacaagaacaatacctggcacatagtaggtgcttaatatgtaatttttgtttaatattgaaccttgtgattgattggatatgggttgtgaggtaaagtaaggaatggaggttattttgtaggtttctcatttattttatttatctatctatctatctatttatttatttttgagacagagtctcactctgtttcccaggctagagtgcagtggcacgatcttggctcactgcaacctctgcctcccaggttcaagtgattctcctgcctcagcctcccaggtagctgggattacagatatgtgctaccacgcctggttaatttttgtatttttagtagagaccgggtttcaccatgttggccaggcaggtctcgaaatcttgacttcaagctatccgcccacctcggcctcccaaagtgctgggattacagatgtgaaccactgcgaccagcaaaggtttctcatttaaataaccacgtgaatcgtggtgcttttcactgagatcaaaatattgaagaaagaagtgggcgggaagtaagaaaaggtcagtttttaacacattttgaggtttaagtgtcggtagtacatatgcttagagatgtccattaggcagacatacttgcagatatggagaggggagagagagacagattttgaaccttcagtattaaaatggtaattaaactacgggaatggtaagacctctcagggggaatgtgtagagctaggaaagtagtgcttttctttctttttttttttttttctttttgatacggagtctcactctgtcacccaggctggagtgcagtggtgaaatctcggctcactgcaacctctgctacctgggttcaagcaattctcctgcctcagcctccgaagtagctgggattacaggtgcttgccatcgtgcccagctaatttttgaatttttaatgtagacaaggtttcaccatgttggccaggctggtctggaactcctgacctcatgatccacccgccttggcctcccaaagtgctgggattacaggcgtgagccaccgttcccggctgaacgtggtggtattaatagagaaccctgaagtagatagagaacctggccttagtaaggaattgaaagaatgatcacatttaaagtggagaaaatgagcttataaaaggagtctggggctgggcacagtggctcacgcctgtaattgcagcactttgggagcccaaggcaggcggatcacctgaggtcaggagatcgagaccagcctgagcaacatggagaaaccccatctctactaaaaatacaaaattagccgggcatggtggcgcatgcttgtaatcccagctacttgggaggctgagacaggagaagcacttgaacccaggaggctgaggttgcgccattgcactccagcctgggcaacaacagtgagactccatctcaaaaaaaaaaaaaaaaaagtggctgggcatggtggctcatgcctgtaatcccagcactttggaaggccgagacaggtggatcgcaagatcaggagatcaagaccatcctgaccaacatgtgaaaccccgtctctactaaaaaaatacaaaaattagccaggcatggtggcgtgcacttgtagtccctgctactcaggaggctgagtcaggagaattgcttgaacccaggaggcggaggttgcagtgaaccgagattgtgccactgcactccagcctgggtaacagagcgagactgtctcaaaaaaaaaaaaaaaaaaaaaaaatggagtctgagccggtcgcaataatcctagcactttgggaggccaaggcaggtggatcacctgaggtcaggagttcaagaccagcctggccaacatgctgaaaccccatctctactaaagctgggcatgatggcaggtgcctgtaatcccagctactcaagaggctgagactgaagaatcacttgaacctgggagacagtggttgcagtgacctgagatcgcaccactgcactccagcctgggcggctaagcgagactccgtttcaaaaataaataaacaaataaacaaaaggagtctgagaaagaatgatcaaagaggaagaactgggggttttacgatccaagtaaagagtttcaagcgagtacagtgtcaaatgctgcagtgtcaaatcctgcaggttaaatagggtaaagactagaaagtgtccattgtattaaatatagagaaaacagtatggtgtctatttttatttatttacttattggacaagtattgagagcttaccatggcaggtactccttataagtgctgggttgatataacagtgaataaaataagtcttgctggagtcgtgagaagggacatgcttgcctgttcctaatcttagtgagaaagcttctaatttctcacttttaagtatagtgttagctgtagggattttgtagacattcttgatcaagacgagaaagttcccctctaagtttatcaagagagtttatcatgaatgagtgttggattttgtcatatgcttcttctgcatatgttgatatgattatgtgatttttctttcttttttcttttttaaacagttttgctctgttgcccagaatggagtgcagtggcaccatcttggctcactgcaacctccacctccctggtacaaacaattctcgtgcctcagccactggattagctgggattatagacgcacgccaccacacctggcaaattttttttatttttagcagatgcagggtttcaccatgttggccaggctggtcttgaactcctgaccttaagccatctgcttgtctcggcctcccaaagtcctgggattgcaggcatgagccactgcacctggcctttttcttctttagactgctgatctgatggattttattaattgatcttttctttttctttcttttttttttgagacagggtcttgctctgtcacccaggccggagtgcagtggcatgaacatagctcactgcagtctcggtctcctgggcttcagcgatcctctcacctcagcctcctgagtagctaggaccacaagtgtatgccaccacaccctgctaatttttaaattttttgtagagatgaggtcttgccacgttgttcaggctggtcttgagctcctgagctgaagtgattgtcccacttcagcctcccaacatgctgggattataggtatgcgccactgctcctggccttattcattttcaaatgttgaaccagccttgtatacctgggataaattccacttggtcttggtatataattctttttatccagtgttggatttgattttctgatatttaattaaggatttttgcatctatgtccatgcaaatattggtctgtagttttcttttttcttttttttttttttgtagtatctgtctggttttggtattacggtaacactgatctcatagaatgagttagggaataatccctctgcttctttcttcttaaagagatggtataaaattgggataatgtttcccctaaaagtttggtagaattcaaattagctaggcatggtggcatacgcctgtaatcccagctactcaggaggttgaggcaggagaatcacttgaacccagaaggcagaggttgcagtgagccaagattgcaccactgcactccgggctggggaacagagcaagactccatctcaaaataaataaataaatgtttggtagaattcatcagttaacccatctgggcctggtgctttctgtttgggaaggttattaattattgattcaattattattattattatttgagacggagtctcgctctgtcacccaggctggagtgcagtggcgcgatctcagctcactgcaacctctgcctcctgggttcaagcaattctcctgcctcagccacccgagtagctgggactacaggtgcgtgccaccatgcccagctaattttttgtatatttagtagagatggggtttcaccgtgttagccaggatggtctcgatctcctgacctcatgatctgcccacctcagcctcccaaagtgctgggattacaggcatgagccaccgcgcccagccgattcagttctttaatagatatagagctgttcaaattgtctttcttcttatgtgaatttggcagattgtgtctttcaaggaatttgtctatttcatctaggttatcaaatctgtgcacatagagttttcctttattttccctttaatgttcatggaatctgtaattatgtcctctcttttatttctttttctgttgttttgagacggagtctcgctctgtcacccaggctggagtgcagtggtgtgatcttggctcactgcaacctcctcctcccaggttcaagtaacgctcctgcctcagcctcccgcgtagctggggctacagcatacgccaccacacccagccaatttttgtattttttgatagagatgcggttttaacatgtgggccaggctggtcctgaactcctgacctcaagtgatccacctgcctcagcctactaaagtgctgggattacaggcatgagccaccacacccagccttttatttcttttttattacttttttgtagagatgaagcctcgctatgttgcccagattggcgtgcagtggctattcacagatgtgataatcatatactgcagccttgaactcctgggctcaagggatcctcctgcctcagcctgtaaagtaactggaactataggtgtgccaccttgcccagctccttcactttaaaaaaaaaaagtttaattttaattttgtagagatgaggtcttgccatgttgcccaggctgggcttgaactcttagcatctagtcatcctcccactttggcctcccaaaggcctgggattatagacatgaaccactatgctcagcctcctttacttttttttttttttttttgagacagagtctcgctctgtcgcccaggctggagtgcagtggcacaatctcggctcactgcaagctctgcctcctaggttcacggcattctcctgcctcagcctcccaagtagctgggactacaggtgcccgccaccatgcctggctaatttttttgtatttttaatagagacggggtttcaccgtattagccaggatggtctcgatctcctgaccttgtgatccacccgcctcggcctcccaaagtgctgggattacaggcgtgagccaccgcgcccggcctcctttactttttttatctagtttctcctacagatctataaagagttgttggcagctctagatgcactgcctatgacttagccctgctctgcatggagcagttaaaaaaaaaaaaaaggagctgttgattttttagtttgttcagcttttacttgttgttatcatggagtggtgacttccgagcttcttttctgctggtctggaaactggatgtgtatatcttttcaaagcagtaacaagaaggtcaatgaggccagagcagagtagtgagtgagggggagagcgttatgaaatgagattggagaggtagccagggtctagctcatgtaatagtgttattaggcatggagagattttgtgttttattctaaaaataatgagaagctattagatagttttgagcaaaggtgtgacatgttctattttaggttttaagagcattgctctggcttttgtgagagtaaaccacaggaggttaagagtggaagaaggaagatgaactagaagggaatgggcagtaatgcaaataagagatgatagtggcttgaatcaaggtgatattgttgaggtggtaagaagtggtggaaatgtgagttgttttgttttgttttgttttgtttttgagatggagtcttgctctgtcacccaggctggagtgcagtggtgtgatctcggctcactgcaatctctgcctcccaggttcaagtgattctcctgcctcagcctcccaagtagctgggactacaggcgtgtgccaccacgcccggctaattttttttttttttttttttaagtagatgtggggtttcaccgtgttagccaggatagtcttgatctcctgacttcgtgatctgcctgccttggcctcccaaagtgctgggattataggcttgagccaccacgcccagccttctgagtatattttgaagacagaactgacaggatttattaagaagttggctgtgagaaagaaagagaggagtcagtcatgacccctagatttttggtctgagcaacactggggaatactaaaggaggaacaggtgtagagaaatggaaagaatcaaaagttcagttttggacatgttaagtttgagatgcagtgggttaaatataagtagagatgttgattaggcagtaatagttggttaaaaagtgcagaggggaggtcgtgttggagataaatttagaagtcatcagtatagaaagtggataagatcacctggggaacgggggagatccaaccgggcgcagtggctcatgcctgtaatcccagcactttgggaagaccaggcgggcggatcacaaagtcaggagttcgagacaagcctggccaacatagtgaaaccccgtctctactaaaattacaaaatttagctgggcatggtggcatgcgcctatagtcccagctacttgggaggctgaggcaggagaatcgcttgaacccgggaggcggaggttgtggtgagctgagattgtgccattgcactccagcctgggcaacagagcgagactgtctgaaaaaaaaaaaaaaaaaaggaagaggtccaaggactgaaccccagagcactctaacttataaaaattaggaacaggatctagtagtgtaaagtaaaaggagcagacagtgatgttggaagttaataatggcctgggtgcagtggttcacacctataataccagcacttggggaggccaaggtgggaggattgcttgagcccaggagttagagaccagctctggcaacacagggagatcccttctttacaacaaatacaaaaattagccaggcgtggtggtgtgcacctgtagtaccgattacttgggaggctgacataggagcccacgaggtgaaggctgcagtaagttgtgatcgcgccactgcattccagcctgggtaacagagcaagaccgtgtttccaaaaaaatagaagaaagaaaataatgaagagtttagtattctggaaaccaaatgaagaaagtgtttcaagcaggagcaggtgataactctgctttttgaactgtgctttctgggaggctgggtaacatggggtctgagaatcagctgttagatttcactggtgacctgggcaagagtggcttcagtggagcagtaaggatgaattaaggccttattggtgtaagttcaagagatgattcatgacaaggaagtggaggaaggagaatttaaaaacttttttgaggatttttgctttaaggggttagaaagaagagtaataaccaggagagctggatagggatgttcaataaaaggcggggttttctttttgtttttgtttctaaggtgggagctattttagaatatttgtttgctaatgagaaaaaaaaaacaaaaggtaaaatccatgttgtggggaaaaggagcaaagctttagagtagtgaaatggaaaggcacccagtgcaccatggaggggttcaccttggaaaggagcacagtattcacctgctgacacacaggaggaagccagaattcgaggagcgattaatcggttggcagttagatttagtggtggaatctgtggaatttctcttctgattatttctgtttttctcctctactgcagtgaactagaaaatgggtaatttcagccagggatggtggcatacagtggtgcctttcagctactcgggaggctaaggcaggaggatcctttgggcccaggagtttgagtccagtctgggcaacatagcaaaacctcatcctttttttttttttttttttttgagacggagtttcgctcttgttgcctaggctggagtgcaatggcgtgatctcggctcaccgcaacctctacctcccgggttgaagcgattctcctgcttcagcctcccgagtagctgggattacaggcatgtgccaccacacctggctaattttgtatttttagtagagacagggtttctccatgttggtcgggctggtctcgacctcccgacatcacgtgatctgcccgcctcagcatccgaaagtgctgggattacagatgtgacctatcgtgcccagccgctaaacctcatctttaaaaaagaagaacaaaataggtaatctttcctaattctccctcttttccttagtaacagaaccctgatttctttgggaacagggtgcccagcttctgttccaactgatggggtccatgtgactaagttctggtgaaatgttagtggaagttgtttggtggggctgctgataaagtttctaaaacaggattgataagattgagctagtgtcattggccctttctttttcttttttttttttttttttttttttgcctagaacatggacaagatggctggggtcctgtggagttctagtaatcttcttacgataataaagcaaccttatgccatatgatatgctaaggatggaggaagatagagtctaggtgcctgatgacaacatggagctgtcaagccctgcattgcctccccctggacgtctcattatgggagaaaatgaagcaatttgtttaagccacactga

SEQ ID NO: 833 - DNA, 766 bp, Homo sapiens
gtggccagcaacgttgccgacaagacggatcctcactccatgaactcccgtgtgttcattgggaatctcaacactcttgtgctccagaaatctgatgtggaggcagtcttttcaaagtattgcaaaattgtgggctgctctgttcataagggctttgcctttgtttagtatgttaatgagagaaatgcccgggccgctgtaggtggagatgtacagctcctcttttgacttggaccatgactttcaacgggattattatgataggatgtacagttacccagcacatgttcctcctcctcctattgctcgggctgtagtgccctcgaaatgtcagcatgtatcaggaaacatgaaggggaaaaagtggcttcaattctaagagaggacagcggggatcttccaagtctggaaagttgaaaggagatgaccttcaggccattaagaaggaattgacccagataaaacaaaaagtggattctctcttagaaaacctagaagaaaattgaaaaggaacaggggaaacaagcagtagagatgaaggatgataagtcggaagaggagcagagcagtagttccatgaagaaagatgagactaatgtgaaggtggagtcggagcggggtgcagatgactttgctgaggaggacctactagatgatgatgacaatgaagatgggggatgaccagctggagttgatcaaggatgatgaaaaagaggctgaagaaggagaggatgacagagacagcaccaatggcgaagataactct

SEQ ID NO: 834 - DNA, 22468 bp, Homo sapiens
gcttccttctttggttagaaccacccggaggtgactgtggccatggctctgactgacatagacctgcagctgcagttctccatgtcccaacccgaagccctccttctcctggcagcaggcccagctgaccacctcctgctgcagctctactctggacacctgcaggtgagtgacgtccccctgggattggggcgagattccttgtctagctttgagtgaaccccagctggctgttgaccttgtgtaagtcacttttcttggggtctcaagttctccactgtgggatgggcagcagcagctcagaaatggtaaatccttcatgaactggctctgcccaccggctccttccaaccatgtttcccaccacaagccctcactggccctttgtgctctgactgcactgaactgctttcagttcctggccatcttatggtcacttgctgccaggcctttggtcatcacactcctcctgccaggtgtgtgacccacccattccctgtacctgccgaactctagtctctccttgaagtttcagtgtgggcatcccctcctcctcggcgagaccccctcctgggcccccatgacccctgcgcatcctggtggcactgcaccaatttatctgcagcaccactgtctgtccatgagagtaacagcaccagtactgcctcagcttcatttttccatttcatccttcaagacaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaaaaaaaaacaaattaacaaatttggggcagccatctctttccacaccccagtgggaagaggactagggcttggtcagtctgctgctgtcattgctgctcattgccacaaggtgtcactgttgaacacctatgtggtgcagtctggtgctgatggctgttgagctctgcaggtagtgatgccacatccctacagagatgcaccataccaggactccaagatcatggttcttagtgttctgcctctgcagttcccatactctgccatcacctattctagcatctgggagcaccataccagagccatttcttgtgtcaatgtcatggtgacagaactatgtccttcatctctccttgagatattcctccaccacaggtcaggcagcttttttttttttttttttcccagaacacagagcatctgcctgggctccctgtccctgaacagttagcctggcttccttcagtgacctcgagaaactttgccaaacttagggggactgatcaacggattctcagttacccattattccaggggtgaaatctagattccaagacaatatttctggtgcttttcactcaaggaaagaggaggagaatttaaaaatacaggttgggtttctagaagagcatcttgctatatgtcagttccttgtgggcaaggaccacatctgattcacaccagggtccccagagcccatccaggcctggcccagagtttcctttggtgagtgtttggaggatgaataaagagatggcaggaaggcaagaggagtggcaccagaggcccttgtcctaggttttctgctctggggccccctgtggggaacccactgtgcttttataagggaaatgatggattcaaagtgctgccccccatctcccattccccgtctctcctcaggtcaggcttgtcctgggccaggaggagctgaggctgcagaccccagcagaaattctactgagtggctccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgatgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacacgaactgaggagtcctcagctacctggagccacgtgacagtctccttcttggggagctggttgcagaggcctctcatcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtagacaatgcctatggccattatgaagctttctccaccctggctcccaaggcttggctgtccgtggagctagctgagccatgcgtgcctgagccagggctacctcctgtctttgccaatttcatccagctgctatcagcacagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcaccctcctggacgtggtgaactgcaaggcccgcttcatccacgatggccctgaggacacctctgaccagctggtgctggaggtgtcagtgatggcttggttgcccatgccctcatgcctgcggaggggccaaacagacctcctgcccatccaggtcaaccctgtcaatgacccaccccacatcatcttcccacatggcagccttatggtgatcctggaacacacacagaagcctctggggcctgaggttctccaggcctatgacctggactctgcctgtgagggcctcgccttccagctccttggcaccccctctggcctccccatggagcaccgagaccagcctggggagccggtgactgagttctcctgctgggagttggaggccggcagcctagtctatgtccactgtggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccgtgtcaccggaggcctgccgttcagggagctgcagaagcagggggctggtggggtggaggatgctgagtggtgggtcacacaggcgttccaccagcaggatgtggagcagggccacgtgaggtacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaactttcaactacagggcacgatgctgtcagacggtcagggcttcacccaggatgacgtacaggctgcagaggtgacctatggggccatggcacgtgcctcagtggcagtggaggacaccttctgtttccatgtcacagctccaccatatttctccccactctgtaccttctccatccatattggcggtgacccagacatgcctgtcctcgtggtgcccgagggtggtgggtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactctgagatcactagaagatgatatcccatttcctgctgccatcaggaccagagcagtggtgacgtggcctgggaggaggtatggggtgtcttctgagtggccatccagcctgtgaatgaccacgcccctatgcagaccatcagctgcgtcttccacgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttttctatggccacaatggcagcctcagctcccgcaacaccctggccttctcaatggatgtgggaccagtgcacacagatgccaccctacaagtgaccattgccctagagggcccagtagccccactgaagctggcccagcacaaggagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgtgtgtgtgcacgtgcctcagatgtgctcccatatatgttgtgttcccaagagtttctggggagcttgctgtacacccatcctcctgggagtggtgtgtgcctctagagctggtgtccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtaccccgctctcttctcagagcccagaccaggaccaggagggtctgtcaagggcttctgctcacccaggaaccccacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccacgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcgtcagcatctgatgaactcatatgtctgtgtcactgagtctggggacatgtgattatgcacctccctgagggagtgcatctcaagctgttgaccgacaccccgtaaccatgtgtggggtgggtattaacatgtgaccagctggggcaacccagtgaaaccccatctctacacaaaacatttaaaaattagccaggcatggtggcacatgactgtggtcccagctacttgggaggctgagcccttgagcctaggacgttgaggctgcagggagctgtgatcacaccacagcactccagcctgggtgacagagtgggaccctgtctcaaaaaaacaaaaaatgtgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcccggagccatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctacttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtactgctggggcctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccaccccccatgtctgctttgagaaagaggccaatgtcccctacttcccggcacagatctccccccctctgagcctcagtttcctcctctgcaaaatgaggacactactgtgtgcctcacgcagttgttggaaggagagatgtgagattgtgctgaaatagaacacaggtgggaggttttgttattggacatttgcaagtacggtaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtggaggcctcagcttggcttcccaaactcctgccccttgtccacagcagagcagggcccccatttggcaaaggtggaagttgaggcccagagatgggatggaacttctccatgattgcaaaagtagttctggtggaacagaaagggcatggctttactaagcccacgtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgtggacgccacagaagagtgggacacagcaccctggaaccacaggctgggatggctgtgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagagtggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccaggcacacatggagggtctgaaaggagactgctgccccaccagtgagctagattaaggagcactgttggtcagcgctgggggtttctgggggtgagaacttggtgacggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagatgtgggagggggccaccgtgcccatccctacagaggctctgaggagcatggatggttactctgggcccaaggacctggtgtacaccattaagcagcccagcaatgggtgggtagtgcagtgggcggtgccgggcactgaggtgcgcagcttcatgcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacggaggcatccactttggcctctctgacggtgaacatacttcctccagacacttagtttctgagtgacggcccagaagcaagtgcttcactcgctggagggcagccggacactgactgcccaggtgggtgtgctgattgtgggcgttcctgggtgcggggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcagggagaggtaagggccccactctgcagccaccactcagatgcgcccagcctcaggtggccactgtgccatggacatcatgtggacatgggcaccagctccagcatcaccggcagcagacactcccaggcctgccatggtccaggacctggtgtcctgccctctaggagtcatcaggctggcagggcaagttcatgttcccagaaggagggagaagaatgcaggaagtcggggatacagggccccagagcagggctggggtcttggggtgtggcttcccgaaggaagctagagctggacccaagggtctggagagggagaaccatgtaggggcactagtggcaccccagcagctggtgaggggcagtgcttggtgggggatggagtcggaggtgaagcagctgctggggcctgtgggcagaggtgtgagcctcgggctcagatcaggtgccagccagaggaagagtggatcctaggagcagatgagctgatgaaaggcagctgagtcggccaaaagggggaagccactgttcatctgtcctggtggcttcagagaagaactagagctctcagccatgggtagtggcagactctctgtggtaactgtgccatgggggccagcccactcatggtttaaatgaacacctctccccaaaggcagaatgggagttgttccatagcagagcagggcagggcagggcagactcttgtgggccgccctgggcaggcagcacacctgatgctcccatcaggaggctgcgtgagcatctggacccagcacatgatcacagtgagttctcggcagggagcggtcttgtggggcgcagagctgactctgtcactcaggagccacggcacgcagcactgccccaagtacctccagaggggatccctgtcagcccttgaaaatggcagagcccaccccagcccccttttcaagctcccttgcttcggcaaggacctcctgagcctggcgctctccctcctgagaggtgcagatggtactcagcaagtgcaaagccgaggtttcttgggcctctcacatcagcacctcccagacctcggttctgtatttccctggagctccactcctgctatggtgcccttcccacaatgagatattcatcaggctggtgtctacagctgctgcgtaccctcagttgctgggagcctttgtcaagaatgcccaggaatgaggagggcacaggacccagaccatcagcaaccctcttgcactctatagtcccatgttactcagagcttccccatgctccagcaagatgaaggactagattgaatgggcaccaggctggcagtgccacccaggaaagctgggaagaggctacatgggctacctggcccactcagggaggagggcaggactgggtattgtcttgacagcaaccctgtcccacaacactgaactgggcagggaaggggtcaggtgtcctcatttttcagataagaaaactgaagctcccagagggcaggtaaatgtattcagagcacatggcgagtaagaggcaaatcttctgccagcaagtccaggatttttttcaccagaggacattgcttggtccccagagctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataggtcttaagtcccctcccagatctgtgacatttgacaggtgtcttttcctctggacctcggtgtccccatctgagtgagaaaaggcagtggggaggtggatcttccagtcgaagcggtatagaagcccgtgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcacgacgagatgctgcacatgcaccacgcgctgaaggaggcgctcagcatcatcggtgacatcaacaggaccactgtcaccatgcccatgcccccgcccgtggacgacacctggttgcaggtgcagagcatccctgacgcacacaggtaccagagactgccccccacggccccaaaatcccccacccgggatgcccagaggagtgccctgggggcaagtggcacaccccctcaccggggtggctcccacctggagtgacggggggagcttgacaaggagcactggctgcaggggggtggggggtgggatgttctcgctgctgggggcggggcttaagctccggcaaccgccttggggtgtggcagggaggagcttcggtgcatgggtgtggccggcactgcgctggggcggggccgcccatctctcccctccctgtgcctcccaggtcgcccaagtccagcgccaggatgcccaggccctgccatgtccctagcccggcctgggtggcagggcccagctcctgggcggcaggacccagctcctgggcttcctcctgctgggtccgcccttggggaagtgtgccccataccctccaggccagaggcttcccctgatccctttgggccctacccccctggtgctcttgtgccccagccggggtccccaggtaagtaggggctgaatgcagccaaagaggccgctggacaggcgtggccaggaaggaaatgggactggattccagagcaccacatctggccgccagaactggccgtctccatccaaggcactgggaccatgggtgccggagccacgtgtggccgagggctggcagagcctgccccccagggatcactgagtcctggaggtggtcgtttttgaggagggggctgtggggctcgtcccacctgccgccttctgtccagcacttgcatgacacttccctctattttcactcttggcggctgcccacactttgcatttctcttcctttcttctcgctgtcctccatcctccattccgtccaactcctagcccagtcccgggggcgcctacttcaggtctgagagtctgaactccgagatgctctgggtgtgtggatttccttcagctaccctgatgtccccaattccaagtcctgactcctttgagccatcccagggggtgtccggccactggaccacaggagcagaggcgagtctgtgactgtgtgaccagcaaggtgtgtgatgtgtgcgtgagcgagcacacgagtgtaaagaatggcacccagacctgagctaggacagagggagcctgggggccacaggcaagctcatttcttctccacacccctccccgcccgaccctgtctaaactaatggggtagtggtagccgcaagggcagggatgggagtggctgaagcctacttcactcccaaagatttctaaggaaaatggttctactgcatcctttggctgggccttgttgacccgtgaccctctttcaagaacattcactctgatttccagtgtgccgtctccactggccacgttctctaaggaagaacaatagcatctgtttttgtttccaaatggctggagagtggggctgtgggaccagcgcccatatataaaaatgaagcagggattggggcttgccctgtgatgtgctgttgaccaagttagaggggtataggcaagcagcaaagtattgggcaagatcactggactgggagtccagagatgctgcttcaccctggggctttaggcaagtccctttccctcccagagcctcagcatcccttttagcaaattatgacattctgcctttctcctagaatggctgtggggatcaagggagacagtggccatagggatgctatgttaaccgtagatgcgtctgtaggagcactttcctaactgccaacgtgagttcagactcttcaggctatttggcacccaggtctatggtgaggtgtgacatatgggatgtaaagtttgatgcctgctctgactccagtcttgctaacacacacacgaaacctttggcaaatcatgaccctgccttggggaaaagggcagtctgggagagcttcttcaaggcagcctggcttcaatgcagtccggggcatgacggagataggcatacgttgtgaggaactggagggtaactgggtaaagagctgcagtgtgggcagaggtgtagtgtgggtcacaatgaggatagccactggccaaagcagggaacagagacagaatgaagagctctgtggggagggtggggcacagggtggagaaccttcaaagtccaaagagtatgacttgttgggattcaatgctgtaggcagtagggagccatggaaggctcttaggtggagaaatgacagccggacattagtgagcaagccctgtctccctgagcagcatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgcggcacgtgccggccggtgagggtgctgggcaccgggaggtggcggagagggcgacgtatgcgtgttgtttgtgggcatgtgttagagtgtgcatgcgggccgtggggcctcacagcatgtgtgtgcacaatctggcgtgtgcgtgtgtccgccacccccaggcctgccccacccatgcatgggacctgccatgtgatttgatgctgtctttcagaatcactatcagtggcccctgaggagcatcagccatggtaggtacatgcctcactgcctgctgcatgaatggtctgcctgccccgctgccccagctccacacagggggcatacctggagcctcagagccaggctgcctgcccctcccttctagagctgcagacttgctctttcctctttctgtccttgtgctgctggctgtctcacttccctccctgccagccacaggactcagtgccactgctcaaggtctccatggctgagcctgggggctcttacaacaggctccatgcccaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagccatgctgccagggcaggtatccagctcccagcctgggagtgccgagagccaaatccactgcagattaggggtgatagtcagggtcccacctcctctatctgtcagcaatccagtggtgatctaggataaaagcctgagagttcaatacacacggttatcccacaacacacttcataggccatgcaaggacacacagcccccttccctccttcccaggtaccatcacagctgctagcgtgtgactgaaggctgggtccctggccagcgctactgaagcactactgccagccagcagactcacggaccttggcctgttgctcctaggggtcacctgtgctattcagccaaggagaccacagtgcttgctggcccagctgagctccgcctagcgagcccacctgcctttcctgccacggagtctccctcttctgcttttcccagcaggaagggcccagcctcacctatgcaacctgcagccccccgccaaccagttgaggctcccctcttagacttataagtctacgggcagtggcatctagctacctgccctccctgccttccccagggtcccttcagtggaccctgggctttctgactgcccagagaggggcctctggcgctcactccagcccgccatcccttatagcttcaccattttggttcaagcagtgttccttctgtcaggcttggtggctgttgggtggggctccccaagcaagaggtggccctgggccagtgggttggaagatggggtgaccacagaagagggaagccgggggggttgagcattggtctgaactgtgggtggactgcctgggtgccatgagagaggccagtgtgtgtggggtggggagggctgccacagcccccaggcactacctatgaagctctagcttctccctccatcttcctcccctttcccttccagcccctcttttccaggaaccttgccacgcccacacctacgccttccccttcccggctctcagatgatggtggtgtttatctccctgttctcgggagcccaaaaagaatggcatgcaggggttgctgcccatgcctgggtgctcctggggagtcctgcattacaggaagcagctgctggatctgctgtgcagtggggttgtcgtggggagaaccctccctgtcctctcctggtgcagcctccacgctatcagtgaggctcacctcacaaagatcttcagagagagggaggggggtgggaatctgagcacagtgcgagcctcccctgctcctgcctgcccaccccacctgagggctctactcaccaccctgctcgtcagcacacccaagctcctgggctactggggctcctagagtgggctcatcagcagggttctgggcaatggtcaaaatttgccatgcccctccttgtggtcgcccacaagctgcaacacctgccccgcagctcctgcaggttcacctggaggaaaggggtgttagctgccatgccggtgccggcacgcacgttcacccccacctccacccccacccccaccgagatgttgcacaccctaccttcatctcctcctggtcctgggccagcctgacgatgtcctcctctcccagtgctgcgtctctgacactgccccctggctgatgtactttcctgcaggaggacatggctcagatgctggggcccctcggatggcctggcagctccccccagcggtgccctagcctctcgctcactatggtgtctgtctgtcctgagaggtggatgaattgaagctctagtttctctacccgctccttcaggtccaccttctccttccataaagtcgctgtggagccaaaataatggggtcacatgtcaggagtcacctgccttgtcctgccccaccgccccccttgttggcccatgccaggacctactcacctgcagcttctccatggccccctgcagggcccggtgggtctccccaaacacagactcacccccactctctggggctggggccgctacctctggcttcttctgggacgaggccactgggtgagccaggggctggcagcacaccctttgttcctcctgggcactggctccagcggagttgaaaaatgccacctgaagacaagaggtgagtattcttgtaggggtatacacataacaactggggcaggcagatggagcatagccccttcctttcgggcctcacagagtgcacctgttggtcacaggtgaaatggtgtctgaccactggctcccaggaggagtgaaagtccacagaagtcagaaggcggggaaaccaagaacataagggggtttcggagggaccacagaggaaggtggcaaagtaggggcagggaaagtcaggctcaccatggcctcccggctctccaggtcccctgggatgttcggcatgggccgaggcgcctcctgctcactgtccagatgtcctcctccatctcctgtggggggtggccagaggggtcctcagacaacccaacaagggaggtacagtgggcccgcctctgcccccacactcactgtgtaaccttgagccagcccctccccagaggggaatgagctgttctttattttgaattttaagaaccaagatcttgctatattgcccaggcacagtcccactaccgattggcgcaggaattctgacctgctccccttctgacctgagccagttctcccatccttaggcaacccgatggccccctgttcccaggaggtcaccatactgatactgaacttagtgcggacaccttgtcggcataatgaccgacacaaaatgcttaaaaggtaacctgactctttgttcagggctcagtcctttagatgttaatctgactgggccggtgcacctaataatatatatcctcctcagtctctctgattcctaaattatgctgctgtacggggagagaggcagcagggtagtggagtcataccaagcaacaagacagggtagtggccaggcatggtggctcacacctgtaatcccagcaatttgggaggccaaggcgggtggatcacctgaggtcaggagttcgagaccagcctggccaacatgatgaaaccccatctctactaaaaacacaaaaattagctgggcatggtggcaggtgcctgtaatcccagctactcaggaggctgaggcaggagaattgcttgaacccaggagatggaggttgcagtaagccaagattgtgccattgcactccagccagggggacaagagggagacttcacctcgaaagacagacagacaggctagtacgttttccacaaatttcaattttactctcttcccccaccacacacacacacaaagcatttgagggatgggaggaagaaactgagatcacaggaaaaattgtaagagacattcagaaggacaggtcttagaaatttactagttttggggggaggtcagaacaggtgtatataaaagaatattaagacagttcccaggtttaggcatatgtgactagatagagtgctaggagatggatacgtgaaaatttaaatatcatcattttgaacacccatgtcactccaagtgagattccctaaatatatgatatacagacagatatatgggtttgaaactctggagatgaatacaaatttaggagtccctggaacacaggtcatgacttaagtaatgggagtcaaagattactcagagaaagcacagaatgagaagagaagaagtaggacaaggaagaagagatcggaggagaccaagaaagggtgataagatcaaaacaggagaaaagaatccgacagaagtctcatttgattatcatgtcccttcccagaggacagggacatgtcttttttgtcttttatacccaattatcacaggtcctggtgcagcagacacacagtttttttttttttaattgtgttgtactattcacagtttcctgtattcaccaggggagaaaaaagtaagtataaagcagcacagacacagatgtttttacactgtgtactaaaggggtcagattatacacaatattttatgccttacttttttacttaatatatcttagaagtttgcacgtgctcttatggaaagactggctgcattttttggtccacaacagaacaacagaatattctattataaaacggtacactataatttttatttaaccaactctttattggtggacattaagaatggaggaatgtttcaacaaaggaacaatcaacagtatcaaaatactgcagaggggtcaatttggggactaagaggggagccactggatttgacaactaggagataaattttagtgcaacgatgaaggcagaatccagagtataatgagctcagtgaaaaaaggtgaagacatgtagcttattctctcaagaaactaggctatgataaactggcagaggctctaagagtgggaggtgagttgttttctccttcatgtaaatatatttaccttttaaacactaggcccaattttatatcctatttcatttaactttatgaacatatttatgtatgtatgcatgtatgtatgtatctcatgtgatgttttagacactgaaaaataactcatttctattataaaactgatatctttagatgttcagaagcaacttcctaaaaggaggtagcagtaatggagctatgtctatcattctttcccatcaacccccttgatggagatgtaaacatgtgtccatcaagcctttaatttttacctcttatcttcatggctctccatacaaaacttaactcttttttttttctatttgtatacgtatatttatatgtatatctatatcgagagagagagagagagaaagagtcttgctgtgttgcccaggctgatctcaaactcctgggctcaagcaatcctcccaccttggcctcgcaaagtgctgggattacaggcgtgaaccactgtgcccagcctcagccttaactcttaaaatatcttcaaaccaatattcttctgttctaatttttaagaatagatgtgtttaaaccaactaacttattttgacaaaaattggagttaagactcagacttcctcaaatagttctcctaaaaccatttacagaataatctatcttttcagtattaagttaaaataccaccttttccttatactaaattctcgtttgcatgactctggttctaaacttccattgcctttatctgtctggcccagggatagtccacaatattttatttactatctggttgaaagagtctatactttattactttttattacttattcttctaaacaaattttagagtcgttttgtcaagtgtcaaaaataaatctgccagaatttgtactgaaatttgtgtgtgtgtatatatataatacacacacactatatataaaatataaaatgtatatatacaatttatatatataaatatttataaaatatgaaatatatatatatatacacacacacttttctagttctttttttttttttttgagacagggtctcactctgtcacctaggctggagttcagaggcatgatctcggctcactgcaacctctgcctcccaggctcaagtgctcctcccacctcagcctcagaagtagttggaaatacaagtgtgtgccacagacacccagctaattgtcatctacccgcctcagcttcccaaactgtttggattacaggtatgagccactgtgcccagcagaaattacatttacaaattaatatgaagacatggtgataactaacatatttataacatgaaatctgctcatccaggaacatagaatgcaaatctttcattccactcagcaaaattttgtcctgtccttgataaaagtcctgcacatctaagtttattcctaggtatttaatttttgctgaaatacctgaaaaaatacttcatcactatatcttctatgtgattatagctaacactggggaaggctattgatttttatataaaagaacttttaaccagtaatcttaaaaattgtttttctcagttggttcctttggatatttttaggtaaacaatcatgtcaactgaaaataatgataaattttctataaagactatgacatcacaggaaaatacagtaaatactttttaaaagaatataaaagggccaggcacagtggctcacgcctgtaatcccagcactttgggaggccaaggtgggcagaccatgaggtcaggagatcgagaccatcctggctaacacggtgaaaccccatctctactaaaaaatacaaaaaattagccgggaatggtggcgggcgcctgtagtcccagctactggggaggctgaggcaggagaatggtgggaacccaggaggtggagcttgcagtgagccgagatcacggcactgcactccagcctgggtgacagagcaagactctgtctcaaaaaaaaaaaaaaaaaaaaaaaaaaaaaaaaaaaaaa

SEQ ID NO: 835 - DNA, 41197 bp, Homo sapiens
ggagaagacagactgctgctttggacctgttggtaatgatggcctgagctaaacatctaactagaagggatacccttccatttcaaagaacagaatgctaaggaagctgtggcaagtatgtgtttcattgttttggtatggtaaaactcagatactgaatgtactcactttagatcccatgatactatatttgtctaaagtttttaaaagctttccttaaaaagcagcagacatatgcttaacacttttttttaatatactttcaaattttaagagctataagtataggactgctttaatttaaaaggagacggcatcatacttcataataaatcttgtatatttataattgattttaaaattagtatttgataaaatctgctgtgtcaggcactataccaagtgctgtgataacagaggtaaacaagacaaaatgtacctttggtatggggaaattgatctagaaattttgctatgcttttgcctatatccagaaaaatgcttcaggatgtacaagaacaaattctgaaactgtattttcaaaacgtaggctactaataatagttaattataagagtcaggatattaattaaatactcttacttatattaaccataccaaaacttaaatatttgaatattgatccttttgtagttcttaagtgtgatgattgggttttcatgcttatgtgtgaaatgtgcctttctcaaaccttgttatgacactggcacattacctgtgtgacgtaaaaaatatatatatatttgaatgtatttgtacataattgtttttatattttatctgattaattaattggcttttataagaagcatttgtcctattgttattttagatgattccagaaaatactaggaaagatttgataaacattaatgtggcagttttcatttttaaaaaatggataacagagttcttataagttgatattaccaatactgattactattatctttcaaagtattttgaaaaatcaaatcattatatcctcagtgaagtgggtaacagttaccttaccattataaatagggaagataatgaccagatgaatggtttttcagtcttcaaaggtaatctcacttggaactgagaatagcattcttgtgttagactggctgtaaaagacttaacacaccttcttgagaaaagtagggaaaaattgttttcagtagaaaatgacttttcgatcacattcacaaactcttcacaagataagagatttcatgatactgctagtttatatatcactttcaatgtattacgtacttacctacctacctgccagctgtggggagaaaactaggatgttagtgtcctagggagagacctttcaaaaagacatttcactcccgcaaatctgtggtcagagcttgccagaaaaaaatctgtccgatttggattcttcttttaatctttagtgtcattaaggtctgctttctcagatggaaaaaaacagatagagaggatagggtttcttacctttcagccttaattagcattagcaaaggtatcctctgacatttgattatctttgaccacaatttcttagatgctttcacttttattatttttattcctgtttgtatattcactttaatacttgattttctattgtcttgagactattttttacagttttcttgagacttatctctcaggtcatgattgtaggttaccagcaatctttaaaaacatttgctgtggatgtaaatttgtgttgtcaaattcctaatttaattttttaagaacttgatgtttctaaatgttttaacattttatttttatttttacattttaactttgaaaataccttaattgtataaaatcacctttattttttttaacacggtggataccttttgttttaatatgacctaattctttgtttgtactgtttaggcattccgtgatttttgtggatttgtaacttctagttgaatacaaacgtgttaaagtattttcagctggctaaacagaactcttgactcagagagaagtgaaactaaatagaatacagagtcccaaacattctcggtatatatacaaatgcagattccaagggattctcagtgtgtatatttttgctacctaagaacagttttatttttgatgctacatcaaaattaacatgatccctaaaaactatagtatcttctaaatgctcttttttttttttttttgagacagagttgtgctcttatcatccaggctggagtgcaatggcgcaatctcggcttactgcaaccttcttctcccaggttcaagcgattctcctgcctcaacctcccgagtagctggaattataagtgcacgccacgacgccgggctaatttttgtatttttagtagagacagggtttcaccatgttggccaggctggtctcaaactcctgacctcaggtgatccacccgcctcggcctcccaaagtgctgggattacatgcgtgagccacctcactcagccctaaatgctcttatttgacccagaattgttgtaaaaaacaaagtttgtggccaggcacagtgggtcatgcctgtaatcccagcactttgggaggccgaggcgggtggattatgatgtcaggagttcaagaccagcctggacaagatggtgaaaccccgtctctactaaaaaaaatacaaaaattagccaggcgtggtggcgggcgcctgtaatcccaactacttgggaggctgaggcagagaattgcttgaacctgggaggcggcggttgcagtgagccgagattgccccagtgcactccagcctgggcaacagagtgggactccgtctcaagaaaaaaaagtttgtttttattcatgtaaaatcttaccaaatagcatgcttttgtggctaaccaggccaacatattgttatctgttaatcatttaatttgaagtccaaacagccagaaaaaccagaagcttgcaaattcagtgcagttgtggctctgtttaattataaaatattttagacttttttttagtagtgggtaagcatagaatttgaaacaatccactaacttcttatagtgtattacattgaggacttatttttaatcttttttaaaatgtagtagaacactgttaaagtatagttttctcataaaacagagaagtaatgattctaagtgcaaatttgcatttgctgtctttataataactatacccttttctcctgaatttcactgccaaaatcattctttgaatgttttatctcccttgttttactcttaattcacagatttaaatatactcaattcatatataaaactgatgtattacaatgacattttagatgttagtaaatgtttattgaatgttcattgctgtactttagtaaatagaatgttttagattcaagggtgttttaatattcatgactaaggtaatttttattaagaattttaccatcgaaagtaatctatagtaaatcaagcacaattgtttttatagctcttctataaatgagtgtttaatgaagtaaaatgtatgtaataatacatagtatagttatatttaaagattttttttttttgagacggagtcttcttctgtcgcccaggctggagtgcagtggcgcgatctcggctcactgcaacctctgcctcctgggttcaagtgattctcctgcctcagtctcccaagcagctgggattacaggcacccatcaccacactcagctaatttttgtatttttttagtagaggcagggttttaccacgttgaccaggttggtctcgaacttctgacctcaattgatctgcccactttggcctcccaaagtgctggaattacagatgtgagccaccatgcctggcctaaagatactttttagcaaacattattggggtcctaataagtattttgttgggccctgggaatatagtggatagctaagtagatactctttctgatcataaaagaagaacttgaataagaactctcaaactttttagattgtgataaaacacattttgctttcattaaatgcttttctgtagagaactattacctgtaaaattgtaaaaattgtaattgttttgatgagttcagaatcataagttgattgatgggtatcctaccctcaggagaagatccagtatacagatagatctacggaaactggctagtctagatctacaccctggagattgtgtttgagtggtcttgagagctcttagagccaatctgacttctcagagctccaaaaactatacctgaatgctacatactgagggattcttgcttccctggaaaatcctttttttttttttttttttactttgatatttccttccttccttcttccaagcctcccttcccctccactcctctcccctccccttcccgcttctcttccttctctttcttccttccttcctactttcctctcttcctccctccctccctttcttttctttctttttttttttttaaacaaatttgcatgtcatccttgcccaagggccatgctaatcttctccgcatggttccaattttagtatttgtgctgtggaagccagcactggaaaatcctttatgtagccatgttttttgccttaataatagaaaagaaaccttgtttccagcttgaccgtagaaagattggtcataaactggccatagaaatattttagtctatttgcaattttagggtcttgaagctgttgtttgttgtactttataataaagcaatgtgataacaatattaaagaaaatttgtaggctaggcaggatagctcatgcctgtaatcccaacacagggaggcagaggtgggaagattacttgagcccaagagttcaagaccagcctgggcaacgtaacgggactctgttctccctaaaaaggaaaaaaacaaagcaaaagaaaaagaaaacttgtgaatatcacacataaaaatgtcacccataatctcgtgaaattttcatttttttacatactctcatttcatctttgttcacatgcatacatatttcctcacagttattataattatatgcaaattttctgagttttaaaaaatttaatagtaaatgggtagtttttccatattccttaattactcttaagattatcaattttaatggcagtatagcaattaaattaatttgatcagttttctaaaaacacttcccgtactgaaaagttaactgaaagcagttttgaaaagtaattacatttacagtgctggatgcattgacagcatacttttttttattggccaacttaattttaattgtgttttaattgcagagtcacctagctactgagttgtgcaactgacctctaacctctttttataggtaaatagtgcaagcttccccaaattgattttgagccctatttttagttgaccttcaaatagaggatgtgatgccttcagctaatagtgatttctatacagcaattttcctgtcccagtcccattgcactttaatgacaaagggagatgaataggaacgacatcctagaaattcttattctgtatttttacttttactttttcatccaatttttgtgcattttcagctgattaagttgctaaaaaaaagtgagagaatttataatattaaaaaatgttatttttttctggaaagaatttttcagggactgaaaatagcatcaattaggcacctgttttgtatcaaagtaagtgaaggaagcatttttacttcctctgatgtggatactactatttctttttcccccagggaagccttctctgcttcttttctagaagcctcctgcagtgtactgatatctttcttactgcactgatcatagttattctaagtaattgtttactgcttgctttccttgcttcactgctggtacctgaaaaaccagagactgcctgtcttggtcaccattgcatcattattgcctttcatgtggttgacattcaacaaatttgttgaattgaagaatcttgagaaaattgaggttgaattgaatagctcttccaggcacctaactactaattgacagaggtgactgcaaaacctgtggctttaccctattcacaatgactttatgaattaattactctgggcctgggattcttcttccataaaaatggggcagttgtactaagattaagatccttgtttcctccaaacttatgactttataataataattccgaggatacctttgtttgccctttggtctatttttagactatacacattatgcagaattgagcttttggaccaaatcttgaaactcttttgggacttctcagtctctttttagaaatatgttaaataatacactgaccttacttttgttagcaaaatcatggggacctgacagtggattatagcaagcaaatagtcttttttttgagacagagtctctctctgtcacccaggctggaatgcagtggtgcgatcttggctcactgcatcctccacctcccggattcaagtgattctcctgcctcagcctcctgagtagctgggattacaggcgcccaccaccatgcccagctaatttttgtatttttagtagagatggggtttcaccatgttggccaggctggtctcgaactcctgacctcaagtgatgcaccgcgcccctgccagcttcccaaagtgctggggttacaggcatgagccactgcacctgtcctctcaagatgagttttcaaatttcatggctgagcaatggctcaatgagaggaggatttttgatgaaactgatatattgtcttgagatctctctctatatatatatgtggggttttttttgttttttgttttttttttgagatggagtgttgctctgttgcccaggctggagtgcagtggtttgatctcggctcactgcaacctccacctcccgagttcaagtgattctcctgcctcagccttccgagtagcgggattacaggtgcacgccaccacgcccggctaacttttatatttttagtagagacgggatttcaccatgttggccagcctggtctcaaactcccgacctcaagtgatccatccttctcagcctcccaaagtgctaggattacaggcgcacccagccgatatgtttaagttttaagcaaaaggcttttaaacacatctcagaacccctgaaaggtggaagtggggattgtaagattcgtggaatttggtcagagagtagtttagcctctgcctcctccaaccagatagctcttctttttttcttttctttctttttttctttttttgagacagagtctcgctctgtcacccaggctggagtgcagtggcttgatcttggctcactgcaacctccacctcccgagttcaagtgattattctgcctcagccttccgagtagctgggattacaggcgctcgccaccacacctgtacggctaacttttgtatttttagtagagacggggtttcactgttggctaggatggttgatctcctgaccttgtgatccactggcctcggcctcccaaagtgctgggattaaaggcgtgagccactgtgcctggccgatggcttctcttttatctgttttgacctgggatttctcatagcattttgtttgatgaaagggctcccctgcttaaaacaaaaagtttgaaaaccaccactttgaggaaaaagtttcagaaagaaaccctcttgccttccaactattattataccccaattaaatatagtctctctcagattccaggaaagtaacagtcacaaaataggttactcctctgcctttcaacaattccctttactgttcaaaatatgagtgctgctcatttattactcttccacttactattttttttagaaacagtatcttaccatgttgcccagtcttgaactcgtagactcagggaatcttcctgccttagcttcctgaatagctggattacagatgtgtaccaccatgtctggaccacttatttggagccatttaaggaattccctgtttctaatgacaaaaaatgatcaaacatctgtgttgatacttgaaaaaaaaaatggcaacccctatttgattaaaagataacattggcttagtttataacatttggttaagaaatagttgtaaatatcagtgatttctttataatatcttagaaatcaagagtgttttaaagaaaaaaagaatgacatctttgagagtagggatctggattattaataccactattatttttaaactgatgctctttatttggtaatatgggaaattagggaacaaaggacatttagtccaattttccttctgctacttggatgtgtagtctgtatttgaataattccagtgaggaggattttaccgtccttcaaagtcaggatattctctcttaggactgctctctttcctaaaaatgtctctccatttactgactagatgtattgtctcatagggacctggttttgcttaataatttttgaagcaaactctcttcttctccattcagctgggatgccagtaaattaaaaatagctctaatttgtggtgaagaataaatgaaatcacttacccattttattcgttttcagttggattagacttcagaaacacaaactttacttagcataaaactttttattttaaaaattttaggtataaaatttatttaaatatattttatgatcctaattcattttttcttgattatttaaagttattattgtgaatttcagatactgttctctatggtgatgcctcctgcaggtcctgttgagttttgtaggactattttcctcttcattctagtcaatttaataaacattgagtgattacctccctaaattcaggcttcttatatgcacttgggaatgcaacattaatgagatgtcagccaaaatagctcagctgggagagtattaggttgaagatacaaagttccttggctcaatccagagtttgggggactttgttttatctcaaaaaagctgtgtctcagtctctttgtgttcctataaaggaatacccagagctaggtaatttagaaagataaagggtttctttggttcacagttctgcagactgtacaagaagcatggctccagcatctgctgctggtgatggcctcaggcagcttccactcatgacagaagatgatggggaatgcatgtgggcagagatcacatggcaagaaaggaagcaagagagacagtggggaggtgccaggctcttcctaacaaccagctcctgcaggaactggtagagcgagaactcactcattaccacatggacagcaccaaactgttgatgagggatctgaccccatgacccagacacctcctattaggctctgcctccaagattggggatcgaatttcaacatgagatttgaagggatcaaacatccaaattatagcaagctgttattaaaaatgagacacaatatctagagtaaggagaccacagatatggatggtggtgcagggacagaaatgtaacattactctgccatgtacagtatggtaagtactagactagaaaataaacgggaggaaatgggaccaaatgaaagggagaaggtgatctctagtaggggtccccaacccctgtgccatggaccagtaccaatccatgacctgttaggaactgggccgcacagcagaaggtgagaggtaggcaagcaagcattaccacctgaactctgccttctgttagatgagcagcagcattagattctcataggagcacaaccctattgtgactgtgcatgcgagggctctaggttgcgcactccctgtgagaatctaatgccagatctgaggtggaagagtttcatcccaaaaccatctcatcccctcgcaccgcggtatgtggaaaaatggtcttccatgagaccagtccctggtgccaaaaaggttgaggactgctgtcctagagggcacacagatcaacacatcaagtgtcctaacctaaggaagggcctgagtaagggtctgaaagtgcattgaatgtctgtggaatggcagccatttctggtatacctaaagcataaggaaacaggaggaaggaaagtgaggttagactaggttgtgaaagggattatatgtcccacaaggagtttgaactttattccttcaacattaggaacctgtgtcaggagactgatgtgattagatctgctttataacttttggtagcattgtggcaagtgctaagaataatgtttctggtaggccaggcacggtggctcatgcctgtaatcccagcacttttggaggccaaagcggacagatcacctgaggtcaggagttcgagtccagcctggccaacgtggtgaaaccccatctctactaaaactacaaaaattagccaggcgtggtggcaagcgcctgtaatcccagctactcaggaggctaaggtaagagaatcatttgaacccaggaggtagaggtcacagtgagccaagattgcgccactgcactccagcctgggtggcagagtgagactctgtctcaaaaaataataataataataataatgtttctgaaactttgatcattcatcctccatctttgctatttttgccatacttgaagcatgcttttggctgatgagatagaccagtaggaagaagaggacataactaatgaactaatggattaaatttcttgtcttttttttttttttgagatggagtctcactctgttgcccaggttggaatgtagtggcatgatcttggcttacagcaatctctgcctcctgggttcaagcgattctcctacctcagcctctggagaagctgggactacaggcacctgccaccacgcctggctaatttttgtgtttttagtagagacggagtttcaccatgttggccaggctgaatttcttacacacttaatggccataatattttagtatctgtgaatgctttttatagtgttaaagttcctccttgttaacattgccatttcacattaataatagtgtgcttgccaaagcaggccctttcccccttgtcttctaatatatagctggctaaaaaatttaaatgaataagcttgtgtctgacccaaggtaaagtacttaacattcaatgagttggcctggagagatttattttgatctttagaggacatttttttctgattcttatcttattctagatctttgtaactgagctatccagccacttcatataagtgaactataactataatttgtttaaaagatcatagttactcattttaaaacattttaaaatttattttaatgtaggtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatgtaagttaagaaaatttttaatctgcgtatatgttcatcaaccacatacattttgaacagtcaccttgttgtatcagtcatcttcatttttgatattttctgaagtagtttttcttttccctaataagactaggtaccactagtatagctaagagataaatgattatcatgtgtagttttattattattatgtagagtttaatgtcttaattattatttttcatatgaattgggttttttttactttgttttgaaggaaagttacccaatctctatgaagggagactggcaggcaggttgaggggattcacaaacaaatactaaagataactaaaatgtattttattgcaatgcccccttcactaaagcttcattttttgcctatttaaggaaataattcaaaaatgaaaactaaaaagaaggggaaaagtacaccaaaggaaagacttaccacagggttgaggattgtgcagttttaggaaactaggtgaaaatgggtatcttttcatcttcattgcattgctcccaaaactttactagacttttaactagagtttaaaatgctttatgtatttatgaaattactcagtatctttttagtaatttataaaattactcaatatctttttctgttaaaagtcaaaggtctgttttaggccatatataaattcatgtttgcttaggcggcatctgtctttgaaaactgtgatataaattatttctgttttagagatcaaaaggcaaataacagatttgatataaacccaattgcttaaaatatcttttcattctttggtataaaacaaacctgctaccagcactaacattgtatttgatttaaagtatatctctgtagtcttaaaaatgcaaataaatatggcttaaatttgaaaggttttggcatgttccttaaatcttagttcttttataaattggattaattaaagttgaactgtagttgcaaatcagatacctgctttggagttaggaattgaattcttaatacttctggaatttaataacatagttttattctttgctattctttgttttggagtgttccggggtaaaagtacactgttttgaaaacaatgcagttgtcatgaaatgtttgtgtatgtctgtcagtagtccaaatagcatcttgctatcagaaatgactgctgtgttcaaacagtaaggaaggaaatgagacgtagaccctcattattattttatacgtgagcatgcttacttatttccttggctttttgcatgagtatcccatcccctacttttatgctctgttattctgtgcagtttttccttaattcccttacatcttctctctggttttatttattttaacaattatttatagagagcttaatatgtaccaggcactattcttactgcttggcaatcctttttcaggttttctccttgttaatattttttaagggataacagatgaaactaaaaatgtacctgttttaataagcagtataaatatcattccaggttatagggtataatgtaatcattttaggttataagaagttaaacagtttcatacagctttatcctgaagtgcagccctccatttcctaatgtcagaaatcttcagagcaggctttcttctgacccagatacataaaatatttttaacaggcattttttttattgctaaacacaagaatgtgcactcagccaagattaaatcaacaaatttgttgctgcagtgaatgttgttgttgtaacctctgcaatgatttttttggggagttgcagtcttccaaaaataatgtgaatttttctgtacagtttagtttgacctttaattttgtatagataattcttatgttatatattaacactgtaatggatactaattctggtcagaaaattcatcctaaaactacagttttcaaaagactgtatgatgtatgctatacatgcactgtattagtccattttcacactgctataaagaacgacctgagactgggtaatttatgaagaaaagaggtttagttgactcacagttttgccggcttaacaagaagcatgactgggaggccccaagaaacttacagtcatggcagaaggcgaaggggaagaaggggaagcaagcacatctcaccatgaccgaacaggagagagagcgaaaggggatgttccacacaactttcaaacaaccagatctcctgagaactcactcactatcatgagaacagccagaggggaagtccacccccatgattcagtcacctcccaccaggctccctcccccgacactccctgattaaaagttatgtatgggcttatacaatttcaaatgtaaaaacagcctatttacatatgttgaaacaataagattttgtggtatcactgtcccttaataattacaattcaaggtaagatttggatggggacacagagccaaaccatattatatacttttgtgatagcatagaagcatgcctttttaaatacacaaaagtctaaatttctgaaacatcaagttatccttggctgagtaaaataatttttcacttataagaggattcaccatagccttctctaaatagttatttcttcatttaaatattgttcaatttaccaaaaaagttaccaaaaccttcccaaaatagttattacaggaagtgaggtacatatatatcttttgcaccttgtatagaaatagaaaaaagtacaagtctttagatttcatagtctgcttattacagatactgacaatgaaatatatactccctgctcatacagtttgaaataaattattacataaagatgataaatgtttataagcaaatctagcatatgaagaacatatacatagatgagttgcacacaaagcctagtgtattatggaagacatatgtggcaggtaatctcaagagaatacaaaagatgtattttcacttttatttctaaaagtagtaaaaattaaaatatggttttctttaaattttcagttttttatgatgtttttcttttttagctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagtttacagtgaccttttttttttcattttattaacaaagtcaatttttaaaacattgtggtaaaatatatatcacatactatttgccattataccagtttttaagtgtaaattcaatggcattaattatattcacagtgctgcaccaccttcaccacttttccaaaagtttttcatcaccccagacagaaactcggaaccattaagcaataactccccattcctcccagcccctggtaacctctaatctactttttgtctctatgaatttgtgtattcttgatatttcaaagaagtagaatcctaaaatatttgcccttttgtgtctggcttattttaacttataatgttttcaagttcatccatgttttagcgtatatcaagactttgtttcttttcatggctgatttatgttttattgtgtgtgtgtgtgtgtgtttgtctgtacacgtgcacttcctcccacacacattttgtttatccatgtatctgttgatggaaacttgtttttttcccgccttttggcaattgtgaataatgctgcggtgaacattggtatacaaggatctgagtacccattttcagttcttttgagtatatcaaggagtagtattcctgaatcatgtggtattctgtgtttaatttgttgaggaaccaccaaactcttccacagtgctaaaatgttctctgaagcatctgtaccattttacgttccactagcaatatacaagcattccagtttctccacatttttgccaacacctttcattttcagttttaaaaagtgattataagcccagtgcgatggtctgtgtctgtagtcccagctaccagggaggctgaggtgggaggatcacttgagcctaggtatttgaggccagtgagagcaatatagtgagaccccatctctaaaaataaaataataaaaattataaccatcctagtaagtatgaagtggtgtctcattgtggttttgatttgtgtttccctaatgatgagtgataatgtcattaggaaaatgcaaatcaaaactacatcttttcacataattatttgtatatcttcctttgaatatattgaaagtttgttcaatcctttgcccagtttttaattgggttgcctttttgttgctgagttttagttctttatatattctggatgttacagctttatcagatacagttgcttcttgacttagaatggggtttgtcctgataaacccattgtaagttaaaatttttgtaagttgaaaatccatttaataccctgatgaactcaccataaacttgaactatcataaactattactattttttgagacagagtctctgttgcccaggctggagtgcagtggcaccatcttagttcactgcaacctctgcctccttggttcaagcgattctcatgcctcagcctcccaagtagctgggattacaggtgcccgccaccatgcccatctaatttttatatttttagtagagacggggtttcaccatgttggccagattggtctcaaactcctgacctcaggtgatccacccacctcagcctcccaaagtgccaggattacaggcatgagccactgcacctggtcacaatcataaattataaatccatgtgtttctcagtttactatggggttaggttaccatgggattatgtgttagtaaatccatcttaagtccatcataagttggggactgtctgtattatgatttgcaaataagttgatcctcattatggattctgtatatgcaaatttgcctacacattaaaatgtatttgtaacccccaaatcagtattcatagtacttccttggtcattcctgcacatgtacagaatggcaacaaaaagatgttcccagcaaaggtcaaccaaagagatgctttgccttgtttcaggtctcatactgtagagaagtgtgtgtgtgtgtgtgtgtgtgtgtgtgtgtgtgtgtgtgtccataggaatgaaaaagcatccttttgtagtctatttagtgctgtgttttccatatttttctgctttctgcagtttaaaatggtcccaagtgtagtgctgaagtgttgtcagtgtttctaaatattagaaggctgtcatgtgccctatggagaaaatatgcgttagataagcttcattcaggcatgagttacagtgctgttagtcatgagttcagtgttaatcaatcaacagtattaaataaggtgtctttaaacagaaaaatacaaaacatggtgatgttttgattgattgataaatatattgtgaccagaggctcccaggaccctaaccctaggagcatgtgttcaggatttgctaattcagtgtgactttatagaatgtaataactgtgaataatgagaattagctgtatttttcccattctgtaggctgtattttcattttcttgataatgtcattgatgcacaaaaaagtttttaagttttccgaagcccagtttatctatttttgttgttgttgcttgtgcttttggtgtgatagctaagaatctattatcaggctgggcgcagtggctcacacctgtaatcccaacgctttgggaggccaaggcaggtggatcacctgaggtggaattcaaaaccagcctggccaacatggcaaaaccctgtctctacaaatataaaaaaattagctaggtgtggtggcacactcctgtaatcccagctactcagtaggctgaggcaggagaatcacttgaacccaggaggtgaaggttgcagtgagctgagatcgcaccactgcactccagcctgggtgataaaccgagactctgtctcaaaaaaaaaaaaaaaaaaatctgttaccaaattcaaggtcatgaataattttcttctaagggttttatgatttttagctcttatatttaggttattaatccattctgagttaatttcttaatatggtgcgaggcaggggtccaacttcattcttttgcatgtggtaatccaattgtcctagcatcatctgttgaagcaattattctttcccccattgaatggacttggaacgcttgtcaaaaaccaattggctataaatgtgtgaaggtttatttctggactcttagttctgttccattggtcgatatttctatccttatgccagtaccacactgttttaattactgtagctctgtggtaagctcaggctagagaggccgtgtttgggatgtgtacagacaaggcagagaaagccattctgcctagacaaacagaataaatgagagtacctaaggtgctagaatatggggcaggcagaaccagccagtgacagacagttctccaagtctccatgaagctctgccattttgtttttgggggatatttaacaacatgtcaaataaagttaactttgaactgatctgctcactgcctgggactttagacaagttacctctcagatcctattaatatttcctcatctataaaaatgggaataatagtatctaaactcagagagattatgagaataaataaaaacaatagggtgcccatagcatgacctcattatagatgctcaataagtgttggttctttccctcccctacttgcagataggacatgaacaactgacttagaactgagaagtgctcctctgttccttttgccatttcctggtcctctctctctctctctcttttttttttttttgagatgtagtttcgctcttgtttcctaggctggagtgcagtggtgtgatctcagctcaccgcaacctctgcctcctgggttcaagcgattctcctgcctaagcctcctgagaagctgggatcacaggcatgtgccaccacgcctggctaattttgtatttttagtagagatggggtttctccatgttggtcacactggtcttgaactccctatctcaggtgatccgcccgcctcagcctcccaaagtgctgggattacaggcgtgagccaccttgcccggctcctttctttcatttacccattcacccatccattcaacaggatttggatctccataaatcaaaaaaacacatttattgcggtggtctgggccaatccctgactgggggctgagttgacaagagtgaaaaagacaccacctctaacctccaacagtccacagagtgctaaatgccaccgtggatggatagaagcatggaagaattacaggaaagaaggagggctgcctggaggaggtgctggttaccttgtgatggggaactcaatcagtcacctcaatcaaaaatcagatttttatagataaaattctacagaaacaggttttaatcacaaccacacaattttggatacttgcagaattccagtttcctaacactgcctaacacttggcatttccttagtgtataaggtggatttaacagtcacagagcatataatacccttctattttattggtttacttttgaaaaatgacattaccctagcgcctctctatcaaatgaggcagtggtgtgtaacttggggtcccagacccctggtcctcagtagtgataggagtctttgaagtgttttcattattgccagaggtccgatgctaatcatattttacctttcttcaggcttcccagggccctaagagctggtgctttgctttcaagtggaattctaatgtacaatgaggccatgccagtagactcaggctgggtagaagtttggattggctgttatataggatctggattctattttttaaaggaaaaataattattagctaataaatgcagttttattttatatagaaatcctccacaactttcagggagaaactgaaagggtcattagtggtaaaaaggctggaaacacccgagcccaggaatcctgagtctaaagggcaaataactaccttttatccataagcaccctaacacttcctgaccgtttcagcagaaaaaaaaatttttttttttttgaggcggagtttcgctcttgttgcccaggctggagtgcaatggtgtgatctcagctcccgcaacctccgccccccaagttcacgggattctcctgcctcagcctcccaagtagctgggattacaggcatgcaccaccacacactgctaattttgtatttttagtagagatggggtttctccatgttggccaggctggtctcgaactcccgacctcaggtgatccaccagccttggcctcccaaagtgctgggattacaggcgtgagccaccactcccggccagaaaaatgttcttaagtggatcttgatgaattcattcatcagtaactaatgcctggaggctgttcagctggagcctcccacctgaggctgctggataaatgagctggttctagattttggcaataattagcagagagatggattctgaaacctgggggagtggattaggtgagtttgtggaggaaaaagttgggttgaagaaagaacgctgaacctggtcaacatgaaagaacccctctctactgaaaatacaaaaaagtagcagtgtgtggtggcccgcgggaggctgaggtgggaggatggcttgagccaaggaggttgaggacgcagtgagccgaaattgcgcctctgcaccccagcctgggcgacagagcgagaccctgtctcagaaataaataaacagataaaattttaaaaaagaaacctggaagacagataaatggtggaagagaaactggtgagagtgaagaggaacaggaaaaaaatcggggaaaacctttatgtttatttcctactgtgtaatatggcacaatattgtgctgtacagtattggccagcattttgtcaacaatctttactttctagagtcaagaaatatcttaaaagtataagaattgtagtaaatgttagtcttagaattttgagatttggtgttctccaggtcgaatgaatgctccctgatctagcctcccacggtatatttctgtgtcttttctttcataaatgcgtgaatgactccggtctttgttattggtggtagtgtctcttgtccggaagcacggagagtacgcattcatttctgtatttcccaagtttcagccacataatgaccgaaacttaacaagttacttaacctctccaaactccaatatcttcaaaataggatttgcaaaatgggaatcactttggctttcataaggtggttgttagccgaaaagaaaaaatgtgcttaacacagtgacgggaatgcacagtggttgacaattggtacttgcaccgggcttagtggctcacgcctataatcccagcactttgggagaacgaggtgggcggatcgcttgagatcaggttcgagaccagcctgggcaacgtagggaaacccagtctccacaaaaaatacacaagttagacggtcatggtggcgcgcgcctgtagccccagctacttgggggactgaggcgggatgataggttgagtctgggagttcgaggctgcagtgagccatgatctcaccactgcactccaacctgggcgacagagcgagaccctgtctcgaaattattttatttattttattttattttattttttattttgagacgaagtttcactcttgttgcctaggctggagtgcaatgatgcgatcttggctcaccgcaacctccgcctcccgggttcaagcgattctcctgcctcagcctaccgagtagctgggattacaggcgcgcgccactacggccggctaatttttgtattttcagtacagacctggttactcaatgttggtcaggctggtctcgaactcccgacctcaagtgatccgcccaccttggcctcccaaagtgctgggattacaggcttgagccaccgcgcccggcctcttattttaatttttaaaaaggtacctgcgagttttaaacagctactctggggccagcgtgctttttgatgcgtgcaggtaaggatcattctgtccatctcctgacacagagaagtcaaaacctccgtcctggggttcggtcagttagtgggtcagataatcatctcagctcaaccactactcccaaccagcagcggccacgtccccgcgtcgccctcaaagactacaagtcccagcgtgccgcgctctgggccgtggaagccccgccttttccggcgggccccgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcaggtgagaagctggggcctcttcgccttatcccgggccccaggcctcgccctccgcggggccccggccccggcctcggcccctccgtccgcgcgaacgcaaaccctggcaggctccagcgcccgccgcgtcccccgccgtccctcctcctccacggggaagcggctttcccaggccccattccgggtccatgggcgagaatccccgcgttgtaagcggcttgactcccacttggcatttggccggcctggctgctgccggctggtctcaacgcccctgccctgcaatctccggtacctcccgtttgtcttcactgctcttacagctgggcagtcaggcctcccaaaacggtgacctccggcaaacccactctcccctccctcttcggcgagctccccctgcccgtaccaaccccgcgctgatggttaaagtccttcagttatatccgtttttcaaggcacatcttaaatgtcatctcctctaggaagtcttttctgatttcgtcttccagccaaatatttttgtctttggcccccttccctctatttagcttctacttaaagcacttgtcagtattcccacaaagtcctgagacccggagtgctaaatgatcgcaccagcatgggttcttgatgcccttggcagtgcctaacagtttttattaataatagtgactccgcgaatatttttgaattagtagagtattacttcctattctttcatgagtgtaaatagttcatcagtcaaaactaatatttatggaaaatacggaagtgttccgggcactgtggtgggttccttcgcatatactgtctcattcgttcctcacaattgtactgacaagatgccaggcactcgataattactgaattgtgtttttggttatttcagttgcattttctccttatcacatacgatctttcaaagttaccttcagccctggatcatgtagactcaaaacagggattgggcttggaaatcatgtggcagaacattaaaaaaactctggttatgagataggactcttgaattccagtgttggctttaaccacttgccttgaaggtgtcagctccttatttgtcccttcagaaaaataatacatgctggctcacagagttatcgtgggagtgaaatgagataatgtatatgaaaatactttgtcagatctgatgtgctgtacaggtgcatagaatttaatataaattctaaaatgaagtgatttttttcttttcttttttttttttttgaggtggagtttgttgcccatgctggagtgcagtggcgcgatctcgggtcaccccaacctccacctcccgggttaaagcgattctcctgcctcagcctcccagctagctgggattacagacgtgtgccaccatgccggcctaattttgtatttttagtagagacagggtttctctactgttgttagccaggctggtctcaaactcctaacctcaagtgatctgcccgcctcggcctcccaaattgctgggattacaggtgtaagccactgcctttccctacgttatttattcaatagtcaagcaatctcagtctcactttcctttttatccataggatttaaatcagtagaaaagcaaataaagtatcctagatgggcatttcctcagacttctctcctacaggtttttggtatttggttgcattggagcctccttctagccttaatttctgtctcctttgctgaaattctagttttttgccattatgacattttcataatagcaccatatctataattcttctttcctatgtcctttcagtaaagaattgtcaatccctattccagtcacactaaagtttatctacaagaaagcatgtctcattttaaagaaccaatgtgggctgggtgcggtggctcacacctgtaatcccagcactttgggaggccaaggtgggcagaggcaggatcacttgtgctcaggagttcaagactaacctggccagactcttgaagaagtctttttttgacgtttaatcaattatattatgggaaattgcttctgaatatgaggtggaaaagcatagctcactctgtaataggctattttcatgatttcaagtggttttatgaagaaacagaaagcagtgatgatgttgaagtgctgactctcaagaaattcaaaggagacctggcctacagacgacaagagtatcaggtagaattcaacatatggtgcttgaagtgggctcttgttttatcagttatggcatatgtaaataacagtgtaccaagttagtgtggtgtttatgaagatgagtttaatcttttgtgatgtgtgtttataatctgaggctcccaagtttccgttcttttctgcttggctctgtatgatttgtttgttttctgtaactccaacaaaaggatctctttggggtccttgtccttgtaggtttattcctcaaggttctgaatctcctcattacttaggaccctctagcacagacatttcacagtgccacaggagcaaatcaccccaaaatgtataagaaaaagaactaacaactagatgttagattgcgttacatatgtatctcatttcatctgcatgagaatcctgtttttattttgctgatgaaaaggttataaagtaagttagtggcaataccagaattcaaagcctagtatatttggtcccagaatgttctttctgctatatcatgatgctttccatagtagtagtgattatattctctagccattccttctctaccttttaggaaagtaggattgactagatgtattagtccatttccatactgccatgaagaaatacccaagactagataatttatttaaaaaaaaaaaggtttaatggactcacagttctacatggctggggaggcctcacaatcatggcagaaggtgaaggaggagcaaagtcacgtcttacatggcggcaggcaaagagagtgtgtgcaggggaactgccttttatgaaactatcagatctcctgagactaactaccatgagaatagcatgggaaaaacccacccccatgattcagttacctcccaccaggtccctcccacaacatgtgggggttatgggagctgcaatttaagatgagatttgggtggggacacagctaaaccatatcactagaatagtgaaatcttctttaattcatttaaatattcatgtaattcattggtcagttataacattactttccacctaggaaaaaaaatcacccctattctgaatccttttttctgttatgttttcctcctttcatttctttatttaacaaataatttccagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggtgagtgattttattgcttattttcacacacattcctataagggtggtcgaatggtgtattttttgaaaacaaaacaaacttcttgctagtagcaaaatctatgggtttggataagcagaagaaaattgtcaggggtgtgagagttttattatgatgaacaacttggaacctagacataatcattttcttgtaatatttttcttgtgtcatgctcaaaattctgtattgcctgaaaatctcctttgcagaggtttttctcttgttaggagtaacattcagtgtggaaggactatgagtgatctgttttcttcgttagattgtttttagacgttgttctccaaaatttctacaatgaacagtatttttctaagccaaaaaaggtcccccccccaaaatgactaaatactcattaccaagccacacttagtagtcctttttatttttaagtggaatttgcagaatttttttttctttttccttttccccagtcaacgaaagggacactttatgacactttattgaggccccagggccatgaggcctgggcaggacgccgctctttggggaaggaagagccttctttgtccttcgtcttggggtacaggttgttggtgtggccgcgcttcttgcgggagttgacagcacggggtggtgcaggcgggcacagcacttgcggcagatcatcttgttgtagttgtatttctgggcgagctggcggagggaaggctcagtaatgccacctcgcaggcgcagcaccaggtgcagggtggactccttctggatgttgtagtctgagagagtgcggccatcctccagctgtttgcccgcaagtatcagacgctgctggtcaggtgggatgccctccttgtcctgaattttggcgttgctgggctcgatctcaagggtgatggtcttgcctgtgagggtcttcacaaagatctgcatctctgcatctggagctcggcagcctcgctgaagaaaaagggaatttttctttctttttttttttttttgagacagagtctcactctgtcacccaggctggagtgcagtggagtgatcccggcttgccgcaacctccgcctcccggattcaaacgattctcctgcctcagcctcctgagtagctaggattacaggcatgcaccaccacgcccagctaatttttgtatttttagtagagacgaggtttcaccatgttggtcaggctggtctcaaactgaccttgtgatccgcccgcctcggcctcccaaagtgctgggattataggcgtgagccactgcacccggccttctttttctttaaaaaaaaattttattgcctttttccacacattctaaagcggaatttttttttaagggataaagaaaggtagttctttccagttctagattttattgcttttgtttctaggttaaggcattatttgtattgattgttgtgtaaattttatatgggaattagtctaaatggactagttttcttcctcggaggaaattaaggagacactgtggcaccgattttgagctttgtggatgtaccgcccagcgatcagatcagcctaacgtatgcacacaattgagctgacatctgccatctcattaactaagagaaatccctaacctttgtttgcttaagccttcactgcataggacctcagcctcttgcaattcgaggaaactttggcagtaattgttctaagaacatggaaaacagctgtgttttgttctttcttttctgttctctactaattgggggttagtgcttaagctgaaagatagataaatcgacttcctaagcgtttgcatgagcagttaacttgatgggatttcattgtgttcatttctagtcttccccagtccgcaaattaacagtgctcttggcccttccggtgcctttctgtagcctttactactgtcctgctcgctcggcgtttcttgcacgtcactgttgtgcttcctcctcctcctctttgattgttgaaggtagtggcagctggattcctggcaggggttgggtcatctctggttccttctagcttagggaatctgtttcggtggctcagagaaggatctgttgccaatcagccgatgccaggtctccggtgctggggatggttactaggcaggagaaacaccagtcagaaaaccctggactttcagaactgtgcatcaggcgtcctggcaacctgttgggcaggactgtcaggtggaaagcgggctcgtggggttcgcccctttctgtcggcttcacacatgatctcagcggaccttgcgtgtctgcacggcattctcatttcctggtaagctgtgttttgttttgttttttaaaatttcttctctacctgaggaccctcgccttttgttactagctctggcccatatctgtttttttgtgacggtggttactgtcttttcacattctgtagggggacctgtcgcagtatgtaacattgaacaaaatagacagcaagtcccggggtggccatcaagattcgaacattttctgttcacaatttctgctgaaattcattcacctcttttcatgatttttggataaaatttatagtaggacttatttcttaaataattacaacattttcttatagtggttggtattcctgtgtggtaactgtggtaagaaaatggctttctggtagtaagtgactccttttcatttatccactcagcactcaacaaacatttcagtcctactattttcctggttctgggttcgatgctaaggagacaaacaatatatcgtgtacatgcagtgctcatctagtgtctggtcggtttagccagcgcacatatacatcagctctttttttctttttgagatggagtcttgctctgttgcccaggctggagtgcagtggtgcgatcttggctcactgcagcctcctcctcccaggttcaagcaattcacctgtctcagccacccaagtagctgggattataggcatgtgtcaccacacctggctacatttttttttgtttttttgtttttgtttttgtttttttgttttttagatggagtctcgcactgtcgcccaggctggagtgcagtggcgcgatcttggctcactgcaacctccgcctcctgggttcaagcgattcacctgtctcagccacccaagtagctgggattagaggtgcccgccaccacatctggctaattttttgtattttagtagagacggggtttcatcatgttgtccagtctggtctcgaactcctgagctcaggcagtccacccgcctcagcctcccgaagtactaggattatagggatgagccaatgcgcccagccttttttgtatttttaatagagacagggtttcaccatgttggccaggctgatcttgaactcctgacctcaagtgatctgcccacctcggcttcccaaagtgctgagattacaggggtgagccaccttgcctggccatatcagctcttcgtaagtaccttttattccttgacttttagtataactgactgtagctctcctgcttaccagccacgttatggcaggcaagttatctaacctctctgtgacccagttgccttatctgtaacataaggaaaattactgaatctattttaaagcactgtcaggaggattaaatgaggaaaacacttagaatagtgcctggcactgcgtaaacactcagtaaatgttaactgtcatcatcatgttattgttacagaaagagttgcagtattctggaaaaatcactcactcatttaaatagattttttttttttttttgagatgaagtctcgttctgttgcccaggctggagtgcagtggcatgatcttggctcactgcaagctctgcctcccgggttcatgccattctcctgcctcaacctcctgagtagctaggactacaggtgcccgccaccacacctagctaattttttgtatttttagtagagatggggtttcgccatgttagccaggatggtctcgatctcctgaactcatgatccgcccgccttggcctcccaaagtgctgggattacagatgtgagccaccacgcccggcctaaatagaatttaatttccagaaggagtttactaatccacctctcaaaaccctactattgacagggcgcagtggctcatgcctgtattcccagcactttgggaggccgaggtgggcgaaggtcaggagttcaagaccagcctggccaacatggtgaaaccgcatccctaataacaattttaaaaactctcttggtgtggtggtgggcacctgtagtcccagctacttgggaggttgaggtgggaggactgcttgaacctgggaggtggagattgcagtgagtcgagatcacgccactgcactccagcctgggcaaaagaatgagactccatctcaaacaaacaaaaccctgtcatcaggatcatagtttgtgagtaacagcctccaccctaacacacacttgctttatcaatatcaaaatgtttttgaggctgggcacagtggttcatgcctgtaagcccagcactttcagaggccgaagggggtggatcacttgaggtcaggagttcgagaccagcctggccaacatggcaaaaccctgtctttactttatgcaaaaattagctgggtgtggtggcaggcacccgtcatcccagctactccggaggctgaggcaggaggattgcttgaaccagggaggcagaggttgcggtgagctgagatcgcaccattgcactccagcctgggcgacgagagcgaaactctgtctcaaaaaaaaaaaaagtttttgaacaatataaagccctatagactggttacagaagaagggtagcatttgttacagatgtagtctatacatgttgttttccttataaatgacatgatttgactttagaaaagtcattactcaaacgtgatttaacatctgtgatggccgaggagctgtgctctgtactaggaatttacattgaacaaaagctcttatggagctaaatggtctgttgggaaggacagatgctgaacaatagtaacaataaaacgagatgtgttctgtctttgggaaggtacagtgtcagcaaatcagtcgtatggggctttatctcctatcttttcactcaatgtgggaatatttagagctgcccgcaggccttcacttgctggtgtacagtttcctggggccgtacaccaggtagttttgctcatgtttcatgctcagtgtggttctgtgagggagcctgatctggacgcttgcaggccaggctttccttagacctcacatcaacttgaaggtaatttgagtctgccatctgctctccgcaaacttcaacttacaaaaagcaggcctgtttttactaacccagaggacatttgccatatggcaagttaggcaagagatgttggcgctggttaaggagatttgaaaaggattttctgatcaaaaggaaactaagcaaccccttttggccaaaaattataattgaccttggtaatggttaccagggaaggcatttggattcaattagaatgcgtcatgaagcatggagagcttcagggctatcctgtttaaaatgtctaagccaaataaaatttggaagtggagtttgttcaaatcctcaaggaaattaccatttggatttttagaaagccttgaatattacaatggaatcattaggccaggatctaagaaaagtggctgggtctttcagatacctggctgaagacagtaaagattataataaaaattggaaataaatggatatttatgtttttgatgctgaacatttggcaggccaccatctaggaattgttaagttattatgacattaggatgtttgggaatggctggtgactctttctctaggtagcatatatctctctgggtttacggtttcaaacatgagatatattgaaatatatttaggtcactcgtatagctactgaaagatacttctaatttataacatatacaacttggttttttaggcattctcattttatatggaaaatgctttgaagtttaaacttcttaaccttttttttttctccttaggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggtaagctgagagtcacttaagcaacgcttggtaatcagctcagagtaaaggctttattttctaattttaagcttcaaaaagttctaggctagacatttggtatatatttttgaaattttcctatggttgtgttgaacgtttgtcattctagtgtgtaatacttggaaacaaaactacatttgtttaagaatacaacctgtgttagctggtgtggtagcacatacctgtaatcccagcattttgggaggctgaggcaggtggatcgtttgagctcacgaatttgagaccagcctgagcaacatggtgaaatcccatttctacaaaaatttttttttgaaaagttaactatgcgggccgggcgcggtggctcacgcctgtaatcccagcactttgggagggtgaggtgggtggatcacaaggtcagaagatcgagaccagcctggccaacatggtgaaaccctgtctctactaaaatacaaaaaattagctgggcatggtggcacgtgcctgtagtcccagctactcaggaggctgaggcaggggaatcgctgaacccgggaggcggaggttgcagtgagctgagatcgtgccactgcactccagcctggcgacagggcaagactccgtctcaaaaaaaaaaaaaagagttgaccaggcatggtggtgcgtgcctgtagtcccagttactcaggaggctgagatggaatgattgcttgagcctgggaggccaaggctgcagtgagctgagatcacaccacagcactccagcctaggcaacagaatgaaactctcagaaacaaaaaggaatataacctgtgtcattgtccaagatggaatgttaagattagaaaacattaaaaaattaggaaaataaaaatgtataaaacactgaaaaagggagaagacatattttaaagaaggaattttctgttcgtatattccacagaaatctactaaagaagaaaattagctcttgtatttgaattgctgataatgggagtagatgatgcttaattcattctacagagaattcccatggtttgtgcctagggataccaagtactttttatctttaaagtatgagtttgagggaagggtagggagaatacacttgaccagttctataaatgatgagagaagaagcagactctctcatgtttcaaatggtaccaaagaatatacagattttttaactcaggaggattcaagaaatattaacagtgaggcttactgagaagtggtatctatttggcaaattttattttattattattattttttttttgagacggagttgctcttattgcccaggctggagtgcagtggtgtgatctccgctcactgcaacgtctgtctccaggttcaagcaattcccctgcctcagcctcctgagtagctgggattacagctgtgcaccaccacacccggctaatttttgtatttttagtagagacagggtttcaccatgttggccaggctggtctcgaactcctgacctcaggtgatccacccgcctcggcttcccagagtgctgggattacaggagtgagctaccgttcccagctatttggcaaattttaaaatgtattcagtggatgcttgtttagattgaccatgtcactaattcagaggcacattgaatgacaaccgtgtgccagacatgtgcttggtgctaggatcacaaagatcatttaaaaagcagtcccttatgcccctcactcactcagagaaatggtatgtctagcctgtaactgccagcacaggtgctaaatagtatatcagtgctgtgaccaacgtcagggagctgttggcgtggccaaaagaaggaagcctttacagaggggatgatgcctctgctgaatggtccctgtaggaacccttgtcagttgactgagtgctagatgctttgtatacattatttcattttaatcctcatgactctgggatacctattgggatcccactagatggatcaggaaactattaaaatcattcccaaagtggtgcaactgtgaagtgcagggccaggatttggagctggtctctgattccagaccctgtattctttcagcttatcttgctcactccacgttaatattccccacgtgggaagaggcatgctaggtaaaaagaaggcaccgcccagaggggcagaggatccgttctagaacagtgttgtcacattgtctggtggtaagagcagcattggtggtaagggctcaaggtaggctgtggccacagtgccagggtggcagaggaagtaggaagtaggactttggcgtcagaactggttttgaagaacttagtcaattgctgatgctaagtggatgaacctgaactcttgcaagcggtctgaccttgcacacattccttaaactctgctctctagttgcttaatcttgacagatggagaaatggggaaaatgcctgcttcctggggttgtagaattaaagtatttaaagtacttattgtcctgcatggtatgtagtaggcatttggtaaatgttagattagtacttttatttttgttgtttttattgttaacacaagatgtttggtgtcacaagggtttggtctttgtgccgaaggcctgaagagtatttgcaggttttaaatacaggagcatgtgataagacctgtgtgtgtgtgtgtgttttgggttttggtgtttttttttttgagacggagtttcactcttgttgcccaggtgggagtgcaatggcgcgatctcggctcaccgcaacctctgcttctcaggttcaagcaattctcctgcctcagcctcccgagtagctgggattacaggcatgcaccaccatgccaggctaattttgtgtttttagtagagatgggatttctccatgttggtcaggctgtctcgaattcccgacctcaggtgatccactggcctcggcctcccaaagtgctgggattacaggcgtgagccaccgcgcctggccaaaacctgtgatttagagagctctggtgactgcgatgctggattagaaggaggagctaaggactagaggttgtagagtaattagtggaagatgatgagggcctgacctaggctggtacagtggtaataaaaaaaagaaatggatgtcactgcacgatagaatagacaggacttggtgaccagcggagtgtgtgggaaggttgagggtgaggagaccggaagagtctctgcagagtctctcgaggatgcacaggtggatggtggtgccttccgctgagataggacatctgggaggatgagcagagccgatttggggtggaaggcaatgattttaggcttgaagtaccgagtcgcgggtgcctggagtatatccagagggcagaaagcaagttacatcaaaggggtaacgaaggtgaatgcttcccgaggccgggtaggtgatgtcaacaggtcagactgaagcagacagatgatcattttacctgtgagtcaggtcaggctcctttctgaaacgcccggatggcttcccattgcacttacgtcaattccgcatttctttccatggcctgcaaggtctgatttgaattggccctgcttttttttcccacctcatttactacacatttttctctctgactgtgttccagccacagtgatcttagtgattttcaagcatatcaaatttgttcctgtgtcagagcccccttctccctggccaagccctcgccaccagatgttctcccactggttcctcatcaggtagctcgtagcttgcctggtatctcaaggaagccttcctgcctataccgccgcatctgaagaggttactgtgtccaccctgtcttgggtttttttccatagcacttgtcactacctgaaatacttatgtgctatctccctccttccattcattccatgaggccacaagtgtgttttgctcatcagtatctctcattgcctagcgtagtgttgggcatgttccacagcatggagagccagtgcttctgggcattgcagtaggtaccagtgagaaaaaaggggaaaatctgcatattgagtatttattaaaaaaaaaaaaaaaaaggagccaaatgaggaagacaggaggaagttaaatgagagaggagaccagctatgatcatgacagggaagtcagtggtaaggtatcgcagagtggttgtcagagggtcatcaaagatttggccctgcttggggtaattgaagtgtgctagcgaatctaattagtccttgcggtcaagttgctgtggggtcagcgagatggaagggtcacagaacactgacttcaaaggagcaaatccagagggcctgtgtgagaggagtctgattgggaggctcgttcctttcactccaaattacttatcctttcaatcccttgacttccacaggaagctcttttgaggccggaagctcttttcaggtgttgctctctgaagatttctttgagcagttttagtctttatattttagaaaagatgaatctccaatgtaaagttgggcaattgattccaagtcggaagctttagggattgaaatgatagttctagtgagggtgggtacctgctttttaacctggtgggacttgcagccgactcaatacctgggctttctgaacatttcctcgcggctttcctttatctggaagcgttgggacttttcgccacgcattgagacttttcggtttttcaggcttctgcttcagtttacccaacctcagcaaacatcgtttgctttggagaggaacttaaggactcagcaggaaattgaagataaaatgaaagggttcagcttcaaagaagacactttgctgttgatagctgaggtgagtgtatccctcgggtttatgtgaaacgaagcatcatagatattttccctggctctgatagcattttttataaagcagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagtgctgaataaatgaatgaatgaatgctta

SEQ ID NO: 836 - DNA, 10633 bp, Homo sapiens
atccctccctgcagcacctcgcctcctccaggcaagaatctgagccttgaccacagctccctctctcacacagcttccttctttggttagaaccacctggaggtgactgtggccatggctctgactgacatagacctgcagctgcagttctccatgtcccaacccgaagccctccttctcctggcagcaggcccagctgaccacctcctgctgcagctctactctggacacctgcaggtgagtgacgtccccctgggattggggcgagattccttgtctagctttgagtgaaccccagctggctgttgaccttgtgtaagtcacttttcttggggtctcaagttctccactgtgggatgggcagcagcagctcagaaatggtaaatccttcatgaactggctctgcccaccggctccttccaaccatgtttcccaccacaagccctcactggccctttgtgctctgactacactgaactgctttcagttcctggccatcttatggtcacttgcagccaggcctttggtcatcacactcctcctgccaggtgtgtgacccacccattccctgtacctgccgaactctagtctctccttgaagtttcagtgtgggcatcccctcctcctcggcgagaccccctcctgggcccccatgacccctgcgcatcctggtggcactgcaccaatttatctgcagcaccactgtctgtccatgagagtaacagcaccagtactgcctcagcttcatttttccatttcatccttcaagacaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaaaaaaaaaacaaattaacaaatttggggcagccatctctttccacaccccagtgggaagaggactagggcttggtcagtctgctgctgtcattgctgctcattgccacaaggtgtcactgttgaacacctatgtggtgcagtctggtgctgatggctgctgagctgtgcaggtagtgatgccacatccctacagagatgcaccataccaggactccaagatcatggttcttagtgttctggttctgcagttcccatactctgccatcacctattctagcatctgggagcaccataccagagccatttcttgtgtcaatgtcatggtgacagaactatgtccttcatctctccttgagatattcctccaccacaggtcaggcagctttttttttttttttttttccagaacacagagcatctgcctgggctccctgtccctgaacagttagcctggcttccttcagtgacctcgagaaactttgccaaacttagggggactgatcaacggattctcagttacccattattccaggggtgaaatctagattccaagacaatatttctggtgcttctcactcaaggaaagaggaggagaatttaaaaatacaggttgggtttctagaagagcatcttgctatatgtcagttccttgtgggcaaggaccacatctgattcacaccagggtccccagagcccatccaggcctggcccagagtttcctttggtgagtgtttggaggatgaataaagagatggcaggaaggcaagaggagtggcaccagaggcccttgtcctaggttttctgctctggggccccctgtggggaacccactgtgcttttataagggaaatgatggattcaaagtgctgccccccatctcccattccccgtctctcctcaggtcaggcttgtcctgggccaggaggagctgaggctgcagaccccagcagaaattctactgagtgactccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgacgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacatgtactttgaaccgaggagtcctcagctacctggagccacgtgacagtctccttcttggggagctggtgcagaggcctctcgtcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtggaggagtatgaggacaatgcctatggccattatgaagctttctccaccctggctcccgaggcttggctgtccgtggagctagctgagccatgcgtgcctgagccagggctacctcctgtctttgccaatttcatccagctgctatcagtgcagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcacccttctggacgtggtgaactgcaaggcccacttcatccacgatggccctgaggacacctctgaccagctggtgctggaggtgtcagtgatggcttgggtgcctatgccctcatgcctgcggaggggccaaacagacctcctgcccatccaggtcaaccctgtcaatgacccaccccacatcatcttcccacatggcagccttatggtgatcctggaacacacacacaagcctctggggcctgaggttctccaggcctatgacctggactctacctgtgagggcctcaccttccagctccttggcaccccctctggcctccccgtggagcaccgagaccagcctggggagccggtgactgagttctcctgctgggagttggaggccggcagcctagtctatgtccactgcggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccatgtcaccggaggcctgccgttcagggagctgcagaagcagggggctggtggggtggaggatgctgagtggtgggtcacacaggcgttccaccagcaggatgtggagcagggccacgtgagatacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaaccttcaactacagggcacgatgatgtcagacggtcagggcttcacccaggatgacgtacaggctgcagaggtgacctatggggccatggcacgtgcctcagtggcagtggaggacaccttctgtttccatgtcacagctccaccatatttctccccactctgtaccttctccatccatattggcggtgacccagacatgcctgtcctcatggtgcccgagggtggtgagtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactccgagatcacagaagatgatatcccatttcctgctgccaccaggaccagagcagtggtgacgtggcctgggaggaggtatggggtgtcttctgagtggccatccagcctgtgaatgaccacgcccctatgcagaccatcagctgcgtcttccatgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttccctatggccacaatggcagcctcagctcctgcaacaccctggccttctcaatggatgtgggaccagtgcacacagatgccaccctacaagtgaccattgccctagagggcccagtagccccactgaagctggcccagcacaagaagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgcgtgtgtgcacgtgcctcagatatgctcccatatatgttgtgttcccaagagtttctggggagcttgctgtacacccatcctcctgggagtggtgtgtgcctctagagctggtgcccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtagcctgctctcttctcagagcccagaccaggaccaggagggtctgtcaagggcttctgcttacccaggaacctcacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccatgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcatcggcatctgatgaactcatatgtctgtgtcactgagtctggggacatgtgattatgcacttccctgagggagtgcatctcaagctgtgtgaccgacaccccgtaaccatgtgtggggtgggtattaacatgtgaccagctggggcaacccagtgaaaccccatctctacacaaaacatttaaaaattagccaggcatggtggcacatgactgtggtcccagctacttgggaggctgagcccttgagcctaggacgttgaggctgcagggagctgtgatcacaccacagcactccagcctgggtgacagagtgagaccctgtctcaaaaaaacaaaaaatatgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcccggagccatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctacttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtgctgctggggtctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccacccccaatgtctgctttgagaaagaggccaatgtcccctacttcccggcacagatctccccccctctgagcctcagtttcctcctctgcaaaatgaggacactactgtgtgcctcacgcagttgttggaaggagagatgtgagattgtgctgaaatagaacacaggcgggaggttttgttattggacatttgcaagtacggcaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtgaaggcctcagcttggcttcccaaactcctgccccttgtccacagcagagcagggcccccatttggcaaaggtggaagttgaggcccagacatgggatggaacttctccatgattgcaaaagtagttctggtggaacagaaagggcatggctttactaagcccaagtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgcggaggccacagaagagtgggacacagcaccctggaaccacaggctgggatggctctgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagactggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccaggcacacatggagggtctgaaaggagactgctgccccaccagtgagacagattaaggagcactgttggtcagcgctgggggtttctgggggtgagaacttggtgagggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagacgtgggagggggccaccgtgcccatccctacagaggctctgaggagcatggatggttactctgggcccaaggacctggtgtacaccattaagcagcccagcaatgggtgggtagtgcggtgggcggtgccgggcactgaggtgcgcagcttcatgcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacagaggcatccactttggcctctctgacggtgaacatacttcctccagacacttagcttctgagtgacggcccagaagcaagtgcttcactcgctggagggcagccagacactgactgcccaggtgggtgtgctgattgtgggcattcctgggtgcagggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggt

SEQ ID NO: 837 - DNA, 964 bp, Homo sapiens
tggccccccgcgccgcagccggcatcgcggcgggacccggagcccggagttcgggtgggtaacccgagctctccaagctcttgaagccgcgagggtggcttagcttcggtgttttggctgagaacacccttaaagcttaaaataaaacctgcctctggggtgcaggggaggagagaggaggacgcgaatcacacccgctgctgcgcgccagcccgccccgtctgtacaatgggatgctcgggactcggacgggaggatccagtgactgcgagccccgcattcgcccgatcccagcctcacacccccagccagcccccagagaccctcccacacttacgaaggaaatgcatgcggccaggaggagaatccgcaccaggaggtcttcaaactgctctatcaccagctcccacagggtcttccctgggggaggaggcaaggggagggccccgggttaaggtctagtgggtgaaggtctgggatggagcgccctggactccggcctgcagtggggaggctctagggtggtgggcagacagcttggtgcccagagaagggctaagaagctcgcctggagtccagaaacagactcggcaaagtggggggcagttcaagggttggctgcttcaaggagaaagcgcctgggagacttctgccccggacaggactctaacctttagggagggagatttgccttttgggaagggatatttgctcaaagaatctaaagaggcagggaggagggagtgggacagggcggggtggggggtggtcatttatgagagttcagggattccagtaacttaccttcctcagcagggagctctacccaggaaaaagaagaaaaggacagattcatttggggttcagcctcatgccccccacacccaagactttgtggctaagagaatcaggccaccttgaggttcatcaagttcatcccattaaaacctcccaaaactctgga

SEQ ID NO: 838 - DNA, 20868 bp, Homo sapiens
gaataaggagatgaagtagtgtctccctccattcaatcctcaaacaattgagagaggaaattcacctttatcatctgagtgtagcaaacaccaagaacagaatacattttgaatgagaggaagagactggaaaatcaactcagggaaaacaagtgagatactgaacaccaaaaatcctgggatgaatggtgatttctatgagcaaagcccagagattgttaactgaataaacaggtcagataactgtaaacagcagtttcaacaacttgcgtgttgaaagtggaacttagaaagtggatgatcccacttctctagagacttagtggttggaacaggaaaattttgaataaattaaaaagaaagggctgggtgcggtggctcacgcctgtaatcccagcattttgggaggcagaggtgggcggatcacctgaggtcaggagttcgagaccagcctggccagcatggtgaaatcctgtctctactaaaaatacaaaaattagctgggcatggtggcaggcacccagctactcaagaggctgaggcaggagaatcaactgaacctgcaaggcggagattgcagtgagccaagatcacgccactgtactccagcctgggtgacagagaaagactcatctcaaaaaacaaaaacaaaagccaaaacaaaacaaaaaaccagtgaacaatagggtaaaaggggacctggaagagacttgaaaaactgaatctttacctcatgcctcctgacagtatattacgtcgaatagcttctgagttgcattaggatattcattcccaaagttgtaggttttaaaaaaactggacacttgaggtaggcatttccttactatatctcacttaccacatggaaagttattatcttcacttccaagaatattgatggaaagtatatttctggtggaaaaatataatggaaatgaggaaaaaaggcaaaatatcactgtagtagagtgaaaaagacaatctttaacccagattggaattctggttcttctacttattgccagtatgaccttgggcaagcttcaaacccccttttaactggagaataactagaatttccactctttttctgaagtatggtttttaaggactcagtgacatataaactgactgtacaatgcctagcacattgcaagcattcagatattctcttccttctccccatgtccacatttttgccatatctcccacagacagcccatgatggagtagaatgggctgattccagtgctatatacggatagtctagggatttagagttaatgctcaccaatatgaaaagcctacttccgtttagattgatcctgttttcctaggtctagcaaaccatatggtgtatcacataccaaattttcagcagtcaccagccctgttaaagcagtagctgcaaaggtcaacttgagggaggggacttttacatttactttatatacttatatggtgtgaacattttttataataaacatgtattttatgtttataaattaagttagaaaagaatcaccactttattcataaagttaattaggaaagagtgaggatttcaaagatgaaggctttgaaggagaaattttccccttccttagccctcagggaatgacagatctggtgagggcaaatggcaagaggggagaaacttccgttgggtattttccagctagacttcatcactttgatttttttaattctgacagattttagcattctcatcgaagaaaatctccaaaggttatttgtgatcccatagttccttttttttttttttgagacggagtctcgctctgtcacccaagctggagtgcaatggcgcattttcggctcactgcaagctccgcctccagggttcacgccattctcctgcctcagcctcctgagcaggtgggactacaggcgcccgccaccgggcccggctaattttttgtatttttttttagtagagactgggtttcaccatgttagccaggatggtctcgatctcctgaccttgtgatccgcccgcctcggcctcccaaccgtagttcctttttaaagggagttatcagttatgactcattttactgatctgcaacactgccaggtgggcctgcagtaagatctctcgtatctatcacaggtaaccatgttggttgtctgctggtatctttctgtgcatgccaacactcaactgttatataatccagtgacataatctttgaatacagataatagagatgtggtaatgccttggcctataactacacaagggtagagaaagaaccagcgtgatagagacaatgccagggcaagtgagaacagacagacgctgggtaattatacctcacagaggaaaaacataagtgaaaaaggccctaagaagtagaggagcaaaaggtcagcacgtgcttgctctgcacaaactttccaggaagaaagcacaggatgcacccaggtgttccattcaacttcaaagtttctaaaaagtgctcagaaaggttggaagactgtttactagaaagaattccggtgtggtatccatgcaaaaagacacctgcacacaagtatgtgactattttttgggtaaactttactggagaggtcaaaaaagaaatttaaaaatgtttttgatgtttttcaagttttatataaaattatcaatattgacttttgccaaatgcatatctagatttatgtatcgaaatgcttatttcaaggattagataacagaatttaagaagagaaggcacattaatcatatactctcaccacattttctcaatcacacagacctggaaacattaggggactcctagagtcagttccatcagataccattagagctgggactacaatccaaacctttgggtccttgtcccatctgttttccacacagtctaaagattgaaaacaatcttcataaatttgtaccactgaaatttttttttttagttttatggaatataaatagcctttttttaactgatattttaaaagaaatatataaaaggtatctgcttgccattccacagcctgctggcctgcagccacacactcatcacctggactgatagattctcttaagcggtctaatgcctgggtccaaaagtagattttctcctttcccaattccagactgcttaccaggttctagattcccaggtctcctgggtctggcctacttgagtggtctttttttttaacctgcggtcatagatttctaccagcattcctagtatttttgccttgttatttaatctgctgttgcccgctgtctgagcacaaacatctaaaaaccaccctgttctttccaagggtgttggaagacagatttctgatgcacttagtgataaattgggaacaagactcaagacatcttccccctccctctttgcagctgtagagctagaatgaaaatgtctaatggctaattcactcaatcacataaatgtctcatctacaaataaaagccaagtacacgtttcttagttttttttgaatatatttacaatataaatactaatttgtttccaaagtacatattcttttaacaatttgagaaaattatctagcatacgacagtaatttaatgtaaagactctatagtagtgattaaggaaaaatagaactgttttggggataaggaatcctggctatgaatgggcatgatgatctgaacttgcaaagggaaagtgaagcagcttagtccacattgcactgctaatacaatatgttaaaggactactatgtgagatagcaacctggatatggtgttataaaaactaaacatgagagatataaaaagtacacatgcttgcatagtgtgttacttttaaagaagctcaacattttattctcattttcaataacttaaatgaacagcacttaacacattacacaaaattaaagacttgtgcatatatttgatttcaacattaatgtcaaaaatacatagtatgattttacataggatttgtgctacattagaacactagagacaaacatcacttgagtattaaggaaaacattaaatattaaataactgagaaaatgtgtaaacactaatctaactgggggttttgctattgcaacatgtccaatgaagtggtttcaacagtacaaaaaggattaggacatgagtttttccagtctacatggaatatatggatttcatttcaggaatcctttcataaaaactggtccaggataacaggagagaatccactctcctgattgttaatttggtacactccattctatgctaatttttacttgcaaacttgggtactgagtaaatactttaaatcatcactccttatcaacatcttggtgaaaactgagggtttgttggtgattcagtgtaagatttgagttcatatgcagcaccgctatcaacctccattgactttctagagaacaggagccgtacgtctctatggaggtagatctttccagatttagaactctggaacctaaacaaataaacaaaatataaaacatttcagagaacgagtctttaaaagaaactagaataattaaaatttgaaagtaggaagaacaaatcttgctacaatattaggtcaacactaactctttaacatgatatttaagatctttctaaagaccaaagcatatgcttttatttaaatgctgctctcttaccattccctaaataactcatactccttttccttccctcagtgcctgagatgcttcttcctgtaaatctgagtgtcaaataaatcttacttttcctccctgactccacagtacatgcacctttcctcatctgcaggttcacgtggcagttcactcacattactcaataacattacatttgggctctgtagccctggcatcttctagctccatagactgacccatttcacacagcttagcctcccatgatttggggtagatgataaaaaactgctataatcagcagtggctaggctaagtaaaacccagccaccatcaaaagtcaagagaaaagttagcagtaaaatgaaaatggctatcaaaactgtatatgaaactgtttctatccactgctaatatctgtaatacagtgcagggatttggaatcttcactcacattaacttacctaccaaacagacaaacataccctgtagtgctaatttctctttgtttttcccttggcatagcataaatactctctgggtttgtggattttactcctgaactagctgaaagatgtggtggttacagctctgtatgttaaaacagactggctctgactggctcactcttccctcctttctgaagtttttcaccttcccaaactgaaggagaacattctttgggaagtgtacagttttccccaaaaaggtttctttaaagtatcctgtcattatgtggagattataaaagctaaggtggctgatttttactctggccagtattggttttggttacaaatagctatggttgttaaacttcaagaggaatgctgtcaaatgcaagtttaaccagagagggttgaatctttttctagtttggtaggtattcttatagtctgctatttcataccatgtcattcattcattcattcattcattcattcatgtgagagtcttgctcctttgcccaggctggagtgcagtggtacaatctcagctcccaggttcaagtgattctcctgcctcagcttcctgaggagctgggattacaggtgtccaccaccacgcctggctaatttttgtatttttagtagagatggggtttcaccatgttggccaggctggtcttgagctcctgacctcaggtgatccacccacctcggcctcccagagtgctgggattataggtgtgagccaccgtgcccggctataacatgtcttttaaaaaaagttttccaagtctgtttttcatagatttttcattcccacaatctgtgtaacatttcccatgtggcttacatcaggtagtgtcagatttggttgaaatacattgtgctggcagaacacgtcttttgcatacagaacaggcagaagactgagatgaaagaactaattaaatagagctttggggagaataattaacggactttcatgtatgggacttgagtgtacagctcactgcttattcactccagaacaccactgcaaggcatatataaagaaagatagcaggtggtccccatcagcaataacagattgaagaagtcttctgcctggacccgagatgaaaggtgactcctcctgatgaacagagtgagactccgtctcaagaagaaaaaaaaaaaaaaaaaaaagaaaaatataaaatgatttatatggctcatattacttttttttttttttttgagatggagtctcattcttgtcacccaggctggagtccaatggtgtgatctcagctcactgcaacctccacctcccgggttcaagcaattctcctgcctcagcttgagtagctgggattacaggctcccaccaccatgcccaggtaatttttgtatttttagtagagacagggtttcactatgttggccaggttggtctcaaactcctgaaggtgattggcccaccttggcctcccaaagtgctggaattacaaggtgtgagccactgtgcccggccctcgtattacatttttaaatagtattcgtttagaaaatgtgtttcactgccccagatgcatgtgttttggcataaaatattttatattaaacagctataaatgaaaacttccctaattcaacaagtaatgaccaccacaggaaggtatgccatgtactttcggcatcttggcacatcatcaagagttcccaagctaagcaaagtcccaagggacactggtctagttagagtcacagtttaaaaaaaaaaactaaaaattttagagttgttctaaagtaacattttcatattaatttgaagcattacctcagatgtatgaggtagcgtaataaccgttcttctgtgtgtcggatgttctctttattaacacttctcttcacttcttgtttaacaggtacagaaaaagttctttgtcgtaggaatgtctgatgattggctggcatatctcgtaaatcatatatcacaacaaacatcttcaccacagtcttattaggattaaataaggtctgaagaaacaatatagaaattattctttaaaaatagtgatttgttgatgtgattcagaatgattgtgccaataatcaaacaagattttaaacaacaaggtaataccactgaatataattcagtttcaaggactaaaattaacacaatttcaaaagtttaagaaataatattattttttaaaaggttcaattttttgttttacaataatataaggtccaataacaaatcaaaatctttagtcacaaatttcatatatataaattttactccttgttcagaggagcaactttaaggaatagttccagtagcttaagcaaaatacatccttattgggttaaaatattccagttcaattatttcaaacataatagctttgctaaagagtatcaagttcaaacttctcaaaattgagttttaatttttctcacattttaatagcaaacagaatatttcaaataaaaatacaagctctgtaaaattagcatgtttgatgtcttaggtacatatgattattataaaatttaaaataggtgctcaaagaagagactttttcctatctgaacatttccccaagtttagaaaacaaagctcactattattaattaattagatctaaagtaggctaatacttcatttactcatacatggaatcatttcaaaatttgtagcaacactagcccttaaaaaattctcaatattattatagaccaaaatatgtatcctggtaaagactgaattaaattcaattgttgcttggttatgaataattgaaggaatattatttttaaagtactcgttttgaaacaaaaccccaagctgctgatctgactttaaccaaattaccaacacatcaataggtaacttggtacccatgctttcagaagctcatccgtggcactggacatcactcactgaatcaaaatgagaaatatatcaatatcataatccagtttttgaaatctagtgagtcttaagattaaggctaatacattcaacaaccacacctcataagccaggagttcaaatcatgtttatacacagttaaactgtatacagaatagaagacatataattaaccactaaagctggcagtctccaaacaagaggtgaatgtgttacctccgagtttatgattcattattatcacaactgacagctagctttccactgacccacactttctcatgagctgcatagccgaaggcaagagaacactgtcactcctttacttcaagaaatcggtttacttgtggtattcttgtggtaattcctcctcaaacttatataaatattactatatatgtgtgtatatatatatatacacacacgtacacatgttacatacttctgtttcattcctgtgtgatatgaaataaacaaatatacagattccttgcagtattggaacaatgatgatgagtaaaagtgatctgacaaagtactgaacacactgaggtcaaaggtcatacaaaggcttgttggattagatcaaatcctgggtatgaggagcaagccttagctagactctctttcagtctgcaaactctgtaatagatttgagggcttgcaggattacgctgggtcagatctagagttaactcaatttcaagctggccttaatatcagattattcttctgagaaccctagaccagggatgatgaaggactgttctgagacagcaggactctcctgagccaaaagagatcaatgcctagaccaaaaggaatgatgccttctctgccctgacatctgtcagactatatttctgctttgtgtggtcatctcattaaatcaattttagaaattattagaaataaaataattttgtttcccaagttttcctgtgaaagcaattctaatatttggggtctccttttaaacaggttcgtctcaatttggtttattaaaaagaaggcaccagtaatattaggttctaaatatgtattgaagagtcctattgaagttatgcaaactgtcatatgctatttttcttaagtattcaccttgattagcttattaatgctttccttttatggaggtccccaaatggtcattcctggggcagagcaggggaactccaaacaaagctgcagccccactgttacttaccaaagttgttgcagcagcagtagcaggagaaagggctaagttctatatgtatgtgagagaatgattattgcaattgtaggctataaaacacataccacttgtattgttcctgaaggaggtactcgataaccccttttaccaagggactctaaagtaatcacacccttgaaataaaagaagacaaattgagtacaaactgatgcatatgtacataaaagactaaaataagaataactcatgtaatttattaaaatttcagaattctatttctatggaaaaacattcatattgaattaatagagatacattctatgtttctacccctaaggaaacattttactgttcctcctggtgatgtcgctataaagaatatataacatcaatggccacagcactcaaaattactattaagatataggaataaaagaaagaagttcctaactaaaaaggaaataaaggaaggtaataggacccttcccatgtatcttgagggagaggggaaatgaagaagcaagtaatttattggtcttcgggcatgtaaaaagtcacaagtgtaggaaagtaagccttggccaaaaataaagtcaattcttcagtctgggagttaagttacatatctggatttctgaataaagacaggaaaaaaaatagaaaagcaatttggaagtctgtagttcctgcctggtactactttatgggataagagatgtttaagacaaaaagtgaaaaatgaaagttaaatcagtaactttaaggctgtggaatgttctatagtaaagctataaaatctcactttcctaaaattaaatatttcttcagaaacaactttatatcatgttgtgtcttaatctggatattattaaggtattttgattttgtttggtcatttacttattaaggaatctaagaatccaaattgattctaaatcagaacacaatggattgagagctgatttgagtcaaggttaaagctaaattagggtcatgtcactagagaagtctaaaagaggatatcaggagtcctccagttagtttggtactcaaagaatgatcctcagatgagcatcatcagcatcacttgtgaactcgttaggaatgtgaaatgtctggcctcttcccagaccttacaaagtcaaatatacattttaacaagattctccagattatatcaatttacattaaggtttgggagccctgctctactatatgaagtagtttttctcaggatgttctccttactgcaaaaatgcaatcaatggggaaaaagtgtatgttaaaacaaggtaagttcaaattgaatgtgtaaaagtttctcaataaccaggatgatcaataaccaggataaccaaatgactatcagtggtaattgtgatacttaattattattattattattattttgagatgctttctcactctgtcaccagggctggagtgcagtggcacaatcttggctcactgcaacccttgcctcccgggttcaagcgattcttctgtctcagcctcccaagtagctgggactacaggaactcaccaccacgcccagctaatttttgtatttttagtagagatggttgggggcaggggcggtggttctaccatgttgtccaggcttcgacctcctgacctcaggtgatccacccgcctctgccacccaaagtgctgggatgacaggcgtgagccatcgtgcccaggctgtgatacttaaagagctttaaaaaatgaatgctgatgcatttacgttaactgggctaatacttttctttcaagtagttaaggagaactgtatgttctacatttcatgatttcattattatacattgtacatgccaaacttatgtaaaagcaaatataaaacagcactgttctatcaggtgacgtctctctgttgggttcggaagttggaccagggttaggaagtaaaaaggagtggataaaggtaaaagggaaagccacattctgacatatgaatttactccaagtgaacaacacttgacatcagattattaaattaacacattaaggttaacacatacgtggttcttgacaaatcagatttgtcatatggttatttaaagcatgaaaaaagcacatcaacaaactgcaaccctaaccaaaacagcaatgaaactttaacaatttatctcttacaatctgccctacgtgcctaatgaggtactctgtataccacttttttttaaatgagcagagtgtggctatttactctacatgaaaaagatatggtatattatacatgttttcttcctagtttcagaaagaaaaagtaaaatatacctaaataatagctatctttaaaatcacataactacacgtaatatattaccgttcttccttgccagccatctgcctccccaccaaatacatacagtaaaactggtaaggcaactactaccaagtttatacttgtttcctttaatacattcaattccaatagtttttagaacacagtaactaaatcaatttatttaaaaaaacagctttttgaaaaaaaccataaagttgaaggcaacaatttaaaacaatttgtaagcaatgttaagactagtagcattggcaagttaggaattttagaaagggactgggaaattatttggaattttattattcatcattattgtaataatttcatcattttaattgatcagcatattaatatttatacctagaaaaagttaccatatttaacacaaaagagaaaaacacattttcttctggcattttttttttttgagatggagccttgttctgtcatccagactggagtgcagtgacacgatcttggctcagtgcaacctctgcctcctgggttcaagccattctcatgcctcagcctcccgagtagctgggattataggcgcccaccatcacgcccagctaatttttgtgcttttagtagagacggggttttaccatgttggccaggctggtcttgaactcctgacctcaagttatccgcctgccccagcctcccaaagtgctgggattacaggtgtgagccaccatgcccggcccttcttctgggattttaaaatggaatagtagggttaaaataaatatgctcaaaatcttatacaaaaattgctcagattattatggaatagggaatatgcacaagtaagtggaaaactgaaagaactatatcttgatctggttaattacaaagaaaggaaatcatacgtggccctaatattataatgaaagtcttattagaaatttgccactggcacacctgccttagatatttctgcctggtttcacactgcaaccgtttctaaacagctaagtgttgtcatataacacttggagaacatttttaccactgactcccaaccggagaataatattatatggctttgagttaatctttaagggaattatttaatgagaagtcctataccacctctataccacaaagataggattttctgtgctaaaattttacccttgtgagtcatttgtataatctgtgataagaggtcccaaaattattattagagtaacaaggttattataagagtaacaagtgttttatgtcttcgctctgctggtctgtgatatgtatagtcttaccaaaacataatcacattctttgaaaacagattcaactacaaaaataaagagaatattccctgaggaacaaaattaattcatagcaggaaagactggaactgggtcacttgcaaaaagaatgcattcctggtaagtaaacttttaatagaaaaatacagactattttttgaaaatgttctaattttttcataggaaaaatataaatgggatagttgactcaagaatgttatcagagaaaagaaagtcagagtttctcaaaagcatagattaaattcagtaacctgatttatacccttgccaatacctatttaacaatctgcaatcatctgcgtgtacatctctagtactttctggagtgacaaaatcttttatctcccaatccttcatttttgagatatcaactaaggtgaaagattaatgctgtcttgctttttaaaagcatagttcaagttacctcttgctcattaatttccatcaaagatatttatttgagctgattttcagccagtttactcttttatcttgtttccaagccatcctaatggccaacagggactctgttcactaatgatagatcacagtattttattttatttattttgagatggagttttgctcttgtcgcccaggctgcagtgcaatgacgcgatctcggctcactgcaacctctgcctcccgggttcaagcgattctcctgccttagcctcttgagtagctgggattacaggcgtgtgccaccatgctcggctaattttttgtattattagtagagacagggtttcatcatgttggctaggctggtcttgaactcttggcctcaggcgatctgccagcttcaggtgatctgtccgccccagcctcccaaagtgctgggattcagatatgagccactgtgcctggccagatcacagtatttgagaccttatctttccatcctctattactatatgccagtaaaaggtgtgaaactgatcagattcttgatgtcctggtaaggcaaaacaggctgttgctatattctcatattgtaagcattcgagtataatatgcatttattctggtattaaacttatctcagtggtactttccattttattaagtgtccaaaattagcagttattttttcaaaataattctggaaaagtgggtacatctttctatggtaaatgaacaggtagcatatgtaataactgggcaggtttgtgaagggggcctcttctttcgataataacctatgctgggcatcttcatgcttatgacccacagatgtgaacgttgttgggaaaagaaaactttgaataaataagcagtcaccactctgctttttctatcaaagtgtcaaacactaatcaagctcttgactaaaatcttcacccttagaatggagtaagctttccttgaagaaactgggccagtaatgagtaggccacatataggttcctaaaagtagcttcctttcctctctgttgtttctcaattgtatagatgtccctttttacagcttttattaatgacaaaagtcattgttactaatgtccttgaaaacctagaaggttgtggagaggggtgttaggagaggaagcagttgggccagatagtaagttaggaaattcaagcagcaagactaggctataatgttcaatgcctacagtaatctgcatttctcaaaagtaacacctaaaatgaaaacccagatttgactccatatttgataccatcactgtcaactttttacagacctgcatggctagctacttgtctctctttgtcttttggaagagggctgatactaatcatatactagtactcagtattgtttttgcaaatgaatgcttatattatccacaagccattggaataaaaaaattggaaaggtgaaatcataagattgatcttaaggctcaacactataactcagaggtgtccaatcttttggcttccctgggccacactggtagaagaattgtcttgggccacacataaaatatactaacactaacaatagctgatgagctaaaaaacaaaaatcacacaaaaaaatctcataatgttttaagaatgtttacaaatttgtgttgggttacattcaaagccttcctgggttgcatgtgggctgtaggccggacaagcttgctgtaactcctcttagttatttcactctccattaagacattagcgtgagtctgaagtagctagtatcctaaagaactctaggattaggccagttgtggtggctcatgcctgtaatcccaacacttggaaggccaaagtgggaggtctgcttgaggccaggagttcaagaccagcctgggcaatatagggaggccctgcctctacaaaacataaaaattagctaggcatggtggcgcatatctgtagacccagctatttaggagctccaaggcaagaggatggtttgaggccagaagtttgaggctacagtgggctatgactgcaccactgcattccagcctaggcaagagagtgagatgctgtcaaaaaaaaaaaagaaccctaggattagaaaaaaataggcccaaagacaaaccaaaccgaaaagggagtaaaagggccatacagaagccttatgtcaccaaagccttgtaggactagaggacacagtgcacactaagcatttgagaatgtgtgtgaactcagcaagatggaattacagtgtcactaatcaatttttatcattttttcaagacaaagagaaataagtacatttttagtaccatccttaaatgcaaaagaggttatctgttgtttgaactagcttagaaagaagttgtgaggtaatattttggcatattagtttgtattcagctgttaggaaatgatttatattttcaagtactgcatcaaagcacttaaatttgtcattaagttggttgatttggcaggaaaacatacaatataaaaaatacttgccatataaggagagggagcattgtcatctgaaacactgtagaatgacacttcaactggaagagtcaaatgtgtggggcagaaagcaccacttgcccctacctcggcagtaaaaccatcaacaatgccgagaggatcgaaacgatagttcaagacagattcctggaagacaaaataattttaaaaactcaattaaaaaagctaacacattcattttttttctatttaaagaaatatacacttagtctaaaggcagagaagtgattaaaagaaatatattactatgctttctagcactagaacagtggttgttaccattgccatgtccttatttctgcttttcatctgacttgaagtcaactgcatctcccatcagtcttctaccatcctacaacagtttggtcttctctcactattccaactcacactgaactctcctgcaacttcagcattagttaggcctaattgtttactatgttgtttttatatctgtaaatttaaaaatatgctctatcagagcaggtatttatccctcacagtgcctattcatggtgctagacacagagaaacacctgaaaacctaacaggttatatatggaagttccatcaaaagatgaagtcaagcacttataattctaaccgagaaataattgcttctcttataaatactgtagtatgtgatatgttttagtttaaaacataaaaatgtgcatttataaaaagtttagaagtacagaaatagtacagaagctccttatccatccctcccccaaggtcactcactgagataactacttttaaaatttagtggttattttcccacttatgagaaacatttaaaacttttcacaagctttattttatataaatatatcaacacatatatgtatacatcatgaaatgtgagtagcattcctttgattaattctttgaaaagaaatgctacaaagcctcatgattctaaaagtttgtgtagtctaaatgtgaaacagtgacatatcagcaattctaatctcctgatcaaaaagataaagccaaaagacctgggtcacaatcaaccttctatatctcctttttgccctctaatcaatccaatccatatcctgttgattttacctctcagtctcagggcctcatttccatccccactactaccactatcctagtgacctaggtgatcctcataacctctcctctgaataaatgctacatcttctaattagtctttccatctgtagtgtatcctctgtactactgccagagttctttttctttttttgaaaaaagccttatagtatcacctaccacttaaaaactttgtttcctgctgtctataggatgaggtcaacattcatagcacagcacttaagctccaccatgcctctcatttcatctctcccaacatatacagagtcccatgctctagctccagttgatcctttccaacattgccatgctcttttacgtttgcacatgaagttccctttgtctagaatctctgattcctgaacaaatttacctggcaaattccttctcatcttttgtgaccaagctcaaatgacagctcctcagtaaagctttcctcaatccttttagcagagatagtagatacacaagtactaggcaacttctattacaatgctaattacttgagtttataaattatttactcacctgggtaaattatatgcccaccttctccagtagacaataaacgtctctaaggcaggaactttatcatttaaactttgtattcctagcacatagtaagtactcaacaaatatttcccaaataaaaagtctattctgaaggtgcaaaaaattttcataggagaggtacatacaaaaatgtttatggattaaggcaaatgaccaatattagttgctgactttatctgagatattttagatttttgtaaatttaatatacaagcatatatgctaggccccactcagtgcagtatgacaagaaaaaaaaaaaaggcacgaaaataaaaaagccaaaactatccctatttatagatgacaagactgtctatgtagaaaaatcccaaggattattttttaaaatctactgaaattagtgagtgagttgagcaagatcactggcgattttttgtagataacacacacacacatacattcatttaaaaatactagcaatgaacaattgacaattaatttttaagttacaatatcccagaaaacatgaaatacttaggtatacatctacaaaaagatatcaaaaatctgggctaggcgtggtggcttacacttgtaatcccagcagtttgggagactgaggtgagtagactgcttgaggccaggagtttacgaaaagcctgtgcaaacacagcagggccctatttctacaaaaattttttaaaaaattagctgggtgtggtggtacaagcgtagagtcctagctacttgggaggctgaggtgggatgaatgcttcaacccaggagatccaggctgcagtgaggtatgatcacgcagctacactccagcctgggtgacagagaaaagtccctacccctattaaaaataaaaaagatgtccaagatatgcatgctaaaaactataaaacactgatgaaacaaataaaagaatatataaataaatgaatttcagggattgaaagactttatatttttaagatgtcaattttcctccaatcgacctgtattaatgtaggccaaacaaaatctcagcaggctattttgtggaaatagacaagatgattctaaaatttatatgaaaagataaaggagctagaatagtttaagcaattctgagaaagaacaataaagttaggactcacattacctgatttcaagactagaaaattgaacatccatatgcgtaaaagggaaccttgatcgcacacctcctatcatgtaaaaattaactcaaaatagatcacagatctaaacgtatgagctaatacaaactttcagaagaaaacagaaaaaaagctttgtgaccttgggttgggccagtggttctcacccaggggatatatggtaatatatgaagacatttttggttgctagaactaggcatgggggtactattggaatcaagtgggtagaggccagagattctgctaaacatcccacaatgcacaaacagcccttcagaagaattatctaactcaaatatcaacagtattagtgtaaagaagccttgggctaggcaatgtttttttagattcaacatcaaaagtaagattcataaagaaaattcgacatcaaaaaacttaaaatcttttactcttgtaaagacactatcacaaaaatgtacagccaaacttcagacttggaaaaaatatttggaaaacatatatgcttatttggcaagtaagtgcaggaaaagaggatcaacatcaatagtcatcagggaaatacaaattaaaaccacaataattaagatgaaaatgactgatcagtgcaaacaatggcaaggatgtggaagaactagaactctcatacgatgctgatgcaaattaaaatggtataatcactttggaaaatagcttggcagtttcttaacagttaaactattctattttattctgttctgttctgttctattctattctattctattctattctattctattctattctattctattctattctattctattctattctattctattctctattctattctgttctattctaatgtagttacccaagtgaaatgaaaatttatgtccacataaaaattcatacacaaatgtttatagcagctttatttttaataaccccgaagtggtgacaacccaaatgtctaaaatcaggtgaatgaataaacaaactgtggtctatccatacaacagtaataaaaacgaatgaactcttgatatgcaggacaacatggattatcttaaaaacaatgacactcacttaaataaatccccaagccaccccctaagagtaaatactgtgtgactacatttatataaaattatagaatatacaagctattttacagtgacagaaagcactaagattccctcatataggaaaaataactcatttccaatggttgtattatgctggactgaactgaatgaagaaaatcacaggacagatgaattgaatggatgatgacaaggttttgcagtagaaaactctaaatcaggggtgtccaatcttttggcttccctgggccacactggaagaagaattgtcttggggcatatgtaaaatgtgaattgtcttgggccacatgtaaaatatactaatattggctaggcgtggtggcttatgcctgtaatcccagcactttgggaggccgaggcaggtggatcacctgagttcaagagtttgagaccagcctgaccagcatggtgaaactcgtctctactgaaaatacaaaaattagctgggcatggtggcgcgctcctgtaatcccagttacttgggaggctgaggcaggagaactgcttgaacccaggaggcggaggttgcagtgagccaaggttgcaccattgcactcagacctggggaacagagtgagactctgtctcaaaacaaacaaacaaacaaacaaacaaaaatatatatgtagatatatatagatacttacatatacacactcattaacaatagctgatgagcttaaaaaaatcacaaaaaaaatctaacaacattttaagaaagtttacgaatttgtgttgggctgcattcaaagctgtcctgggccgcaggctggacaagcttgctctaaatggtggcaagaaaaggtgactattagctattagactatttgggtgttattctgtgtccatgtgtttccagactccacctaatgccccacaaataatgtctaaggatcatgatttcccccaacaacattacagggataagactttgccctgttttcattaaacaagtctaatgtgtcattttagtgactcaagtctaaccccatcttttattgcacagaatgtcaaattcactaagcagaggaaatatcttctgtaatttactgaagaaaacatcaaattcattataaataagacctatgggttggatagtctcagaacatctctatttcttaagtcacttggaaaatgtatgtatatctgcacaaatagaatcgtctgaaaaaaa

SEQ ID NO: 839 - DNA, 2383 bp, Homo sapiens
ttgatctcctgacctcatgatctgcccacctcggcctcccaaagtgctgggattacaggcgtgagccactgcacccggccacctatgtttcttaaatatagaaatgatacttgaggaagtgctaactccccaagaatatatttaaaacaaagatttcaacccacgtgcataacttactatatgaacagacactactgcaagagctctacctgtattcgttcctcgagccatcctggcaatccttgtcatataatttatatttcacaggtaagaaaatggaggtgacgcacttctgagcttagggagggctcagctctaaccctgagtaaacatgaccctgttttttggcttttttttttttttttttttttttttttgagacggagcctcgctctgtcacccaggctggagtgcagtggcgcgatctcggctcactgcaagctctgcctcccgggttcacaccattctccggcctcagcctcctgagcagctgggactacaggcgcccgccaccacgcccagctaattttttgtatttttagtagagacggggtttcaccgtgttagccaggatggtcttgatctcatgaccttgtgatccacccgcttcagcctcccaaagtgctggaattacaggcgtgagccaccatgcccagcctgtttttttgctttctaaatgctatgatctgaatatttatgtccccacaaaattcctatgtggaaacctaatcgcaaatgagttgaggcctttgggaggtcattagggcatgaggatggaaccctcacaaacaggactagtgaccttctgaaagaggctcaagggactgtgctcaccccttctgccatgtgaggccacatgcaaggcactatctatgaggaacgggcccgacatggaatctcctggcaccttgatctgagacttctcacgtccagaactgtaagcaataaatgtctgttgtttataaattacccactctaaggtattttgttatagaagcctgaatgctctaaaacactgaaatatagcataattatatatttttcacaattagaacacacctaaaatggagagagaattagaattgtccccaagagccctgcaatttggaaacccaagccagctggtttataaaatatccatgccctccataaccaccttgtaaccttcctattccctcaccgtagtcagtcaatcaaggggaacactcgctccccacccctccaccttttgcacccttctccactccttggaagtcatctgtgacttcttttctgatcccatgctgacagtggtgttccttttcatctgatttcatctgcacacaaatgctgggacagacaacccagcactttctcccagaactttgaacaagaaatatttacatgcagggcgattagtctctggctcacgagacagtcaatccagacaacaccactctggatggaaggtacagaaatgagatgtttttctgtctctgctgtggccaaggagtctttcatttaaatgtcaggcttctactcaccagttgacaggcatgcttgatcctctccacaaacccatcaagtcccaagtattgtaaagataaccacagaggcagggcacggagtttgtctgtgggcttatttgatgtaagaccagcaactaaagtctaaaaaagccaaaagaggtttattaatcaaagccattgcaatctcataatagaactaaccagctaccatttgctacccacttagtgtgggctagatgccatactagtcactaggcttgcattatccatgtgatcttccaacaactctgtgagctaagtattctaggtaacttcactcagagacctcggtttgtccaagggttcacagctcaggagtggcaaagccaggaaaagccagtggaaaacccagatgggtcacatcccagaacctaggagactccccacttcgaaggtagctctgagcatcctcaaacacctggccattattagctgagcaagacagcagtgttttagcagaaatcacttaaaccttattttgcacgctgacctatattatcaagaaccacattattattattattttttgtgacaggtttcgttttcattctgtcgcccaggctgcagtgcagtggtgtgatcatagctcactgcagccttgatctccagggctcaatcagccctcccacattagcctcatgagtagctgggactacaggctcacaccaccatgcccagctaattctttgttgttgttttttcttatagagatgaggtttcaccatgttgcccaggctggtctcaaactcctaggctcaagcgatctgcctgcctcaaccttccaaagtgctgggattacaggcatgagccaccatgcctggcccacaactacgatt

SEQ ID NO: 840 - DNA, 68479 bp, Homo sapiens
ggatgttgtggggatctgcggccgcctggcccagcttcccgcagccgcccggcggcggcctgcgctccacttcgggagtggtagttcttctcttcaccgctgccgggcaggaggcgcaggcgggactacgcgtcacggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcaggtactgtactaggcgggcttagaccccgggagggggtttgtgccgactgtctgagtccctggccgacacgctcggctcagtagaggagcagtggcggggtccgcctcctaggctggggctgctcgggcggggacttgacgcctggtgtcagcggccgcacgggcgacctcctcgggccgtgcgcgagtgcacagctccggaggcccgagccgaccctggggcgtccggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatggtaagatgttatgtgcgtcaccctgccgggtttaatgccagcctgtcttttgatgacatttgagcccccgtgatgtcaggaatagaaagattaaatattaaataatgcccggagacttccgctagcacgccagcctgatgatgatcaaatacctctccatatccttctccagttccagtggcctcctttagctttggtctccctaatcgatttgtcctcattagcagctgtcccatgcagtgccttgtacgcgttgtttatgtttagcactattgggagcgccaagtaaggtattttattgagtggtgaagtttgcactgttctgctctacttttattgaaaaacacagttgggcattcttgtagttagaatagctaactatatagtactatgaattttagatttgtctcctccaatctacaggatagtgcttgaaatatcgctattactgcatcgtatcttttaagattagaatcatattgggtcccacacgtctcaggggatatttatcacacacatccagtgtgaatggtttacttttattttctgagttcaggtcatatagcagaagatggagatggtgagggtattattttaattcatattttttttttttttgagagagggtttcgctcttgttgcccaggctggagtgcagtggcgcgatctcggctcactgcaacctctgccttccagtttcaaacgattctcctgcctcagcctcccgagtatctgggattacaggcgcccgccaccacgcccagctaaattttgtatttttagtagagacggcggggcgggggggggggtctcaacgtgtcggccaggctggtcttggactcctgacctcgtgatccgcccacttcggcctcccagagtgctgggattacaggcgtgacccaccgcgcgggcgttaattcataatttttaaccttttacgctgagggcggaatttcagtcaaaaaagctgattaaaaatcagcccaaatacaatttaaaggtgtgggaaatactccttcttagatgaaaacagtttagaaaatagtgtaattgcaattttgtaaaccatggaacaaaaagtgaacataacttcttttagaaatgacttaaagggtccagagcggtggctcaggcttgtaatcccagcactttgggaggcccatgcaggtggatcacctgaggtcaggagttcgagaccagcctggccgacacggtgaaaccccgtctctactaaaaatacaaaaattagcctgtaaacccagctacttgggaggctgaagcaggagaattacttgaacccgggaggcggaggttgcagtgagccacaagatctggccaccgcactccaacctgggtgacagagtgagattatctcaaaaaaacaaaaaaaaaaaaacaaaaaaaaaaaaagagaaaaagaaagaaaagaaataaaggatattcacagttataaaagtgtagatagtgaaactagaaatgatttttcttgtactttcctgtatttttcaagttttctgtagaaaaaacttttaaaaaaggatgcaagtattaacagcactttgagagtttctatatcatttttttcactttctagtggaaagccccacccttatgcaaaaaaaaaaaaaaagcagcaattccagttatggactctatgaacattactttaaaaagaaaataaaggcctagagcagtggctcatgcctgtaatcccaggactttgggaagccaaggcaggcggatcacttgaggtcaggacttcaaggccagcctggccaacgtggcaaaaccccgtctctactaaaaatacaaaaattagctgggcatggtggcggatgcctgttatctcagctattcaggaggctgaggcaggagaatcgcttgaacccgggaggcagaagttgcagtgagccgagatcatgccactgtactctagcctgggtgacagagtgagactgtctcaaaaacaccaaataagcaacaacagtaaaaaacacaggcaaagtccctgttgctgcatctgtagactatatgaatttaagtgtaaattatttggagagtagggacaataaatgaaatagttggactcgaagaaaataacagatccgacaatttgtagcatttgtagatctcattttattttttggagatgatgtcttgctctgtcacctagtctggagtgcagtggcctggacacgacttactgcagcctcctgggctcaagtgatcccaacacagcctcccacatagctggggctacaggcacatgtcaccaggcctaggcctggctattactttttttgagacagagtcttgctctattgtatggtggttcagtctcggctcactgcaacctctgcttcctagtagctgggattacagtgtgattcaagctgagttcaagtgtgattctcctgcctcagcctcccagtagctgtcacatgtcacagacatgtgacaccatgccccactaaatttttttttgagacggagtttcgctcttgttgcctagactggagtgctatggcaagatctcagctcaccacaacctccgcctcctggtttcaagtggttctcccgcctcaccctcccgagtagctgggattacaggcatgtgccaccatgcccggctaattttgcattttttagtagagacagagttttttccatgttggtcaggctggtctcaaactcccgacctcaggtggtccgcctgcctcagccttctaaagtgctgggattacagacgtgacccactgcccctgacctaatttttgtatttttagtagagactgggttttgccatgttagccgggctggtcatgaactcctggcctcaagtgatctgtccgccttggcctcccaaagtgctgggattacaggcacgtagctgggattacaggcacacaccaccatgcccggctaatttttgtatttttagtagagatggggtttcaccataatggccaggatggtctcgatctcctgaatgcgtgatccggttgcctgggcctcccgaagtgctggcattacaggcgtgagccaccgcacctggccctaattttaaaattttatgtagaggcagggtctcgctatgtttcccaggctggtctctttgaactcctgggttcaagcgattttcctgccttagcctcccagagtgctggatacaggcatgagagctccatgtctggcctgtacatcccatcttttgatctggtttcttttcactttgtacagttaaatcagaggtgaaagtacttagcttttcttcacttaagcctggaaaatcttaaacttgtcaacattgaatcacgttcagaaccatgttttatatgtctgatattttggcttatgtctatttttgtttttattttttgttatggttatgttggatatggactggtaagtagtataatcaatcattagcccacattttgctttctgttgtaaagggctacattgttcttccacagtaatatacagtacatttttcttttttttggctactatcagcccttaaaaattaagggggtttaccttaacaccaagtgtccattaacactggataaaatatctattctaaagtgttttacaaaaaacactggtaacacgttgtttttcaggttgtggtgttcatactttattttcttaggttgtcttctttggagcttgcctactccaaatgtcaatttcttttcaatattttttaccttataattttgtatattctgtgtactgagttggctcaatatgttattaggctttgggtctattcacagggcataagaaaaattcataattgattaacatgtctgatttactaactcattccacagtattattgtatgggttgtataattatattcttatgcaagttaaagaaagacttttaaaaattaggtgcatatgaactgctaaaatcatggaagtagtagtttttgaacatgttaagaacatgaacacagcagcaaggcctgttaagtccaaggtactttaaacaaaaaatgcagactcatctaacagtgcagaactgctggaggctgaattatgtttgtgtttctttgtggtgaagatgaggaagttgcagtattgtaagtgataaaggattacattttcacaaatttccttcctgacagttccataattgtaactagactaaaacacttggtttcaaaggtcatttgcaatgtattgcatcagataaacttggccatattttctctcaatttgagttctaagatgaaattcagccctatgatatgggaaggattgtaattaagtgataaataaagggattttttcccccaaagggtatttaatgtgtggaaacctctttaagggtctatagaattacctgaggaagtattagaaaataagaagtgggagttaagtatttttttctgtcatcacaggaagcctgaaatctttttttttttttaagtacttatccaaatcactattcttttaaaatcttacaaaatcttacttctggttcatattgccagcatgttgaaatgtaaaaagagcattaggttggaaatcagaggatttttaatgatgttgaggaagttattatttataattttctgttcgttttcatttggaatttgtaaataatagcaagctgcctttatgggggtatttgtgaagattaaatcagatatgaaaatgaaattgctttgtaagtggtggagttatctactcatatgaagtattattgtactaagtgcatttacataaagcacttatatgtttgaagtgtgatgccttgatgtgataaatactttttgactgggaagtttgatgaagaaaaaaagtcaaatgggttattcatttgatttcttggtagagattggtggctttttccagactgaaggaaacctggctcctctcctgactgtgactttgcactctgttgcatcaaatgtcctgaaactgcagtgtacttctgtggttgagcttttaattttggttttgatttgttttaatctcacttctataagtgtaagaatggtcatcagtctagtttgacaataggaagtagctattgtttttaatattctcaaatggatctttaagttatttcatgaacaatgagactacattgaatgtgaaatctcaggtcctctgagaaatacatttcatgtttaaagcattagtctttgagccaaagaaataatggagtttagatttttccttctggggaagttatctctggctatgagaggatctgacccttgagattaacttcaagttaggttgatatatagaatatttacgataaagaaaaagtattttagaaacaagtacatattggctgggtgtggtggctcatgcctgtaatcccagcactttggaaggtcgaggagagtggatcacctgaggtcaggagtttgagaccagtctggcccaacatggtgaaaccccgtctctactaaaaatacaaaaattagcctgacttggtggtgtgtacctgtagtcccaattactcaggaggctgaggtgggaggatcgcttgagccaaggagtttgaggttacagtgagctgtgatggtgccactgtactcccgcctgggtgagtgacagagcgagatcctgtctctaaaaataaagctataataaagacattaacaaataaaattggagctatttatcaaaactttgaacttaatactaattaataaagtagctcaaggaaaaaagtaagtagtgtaagctaccattaggcaaattatgctgagaagtatagtaagtgctatagattcaggggaaaatgaaatctgtatgtcagaaacagtgatctaggaaaatttcatgggagaagacagctttaaatacagaaatcagaatgaaggaagaaaagcatttcaggaagtgaagacatggagttagggttgtccattttgtgttcagaagacagcaattaaattacttcagccatatgacgaggaaagctaatcagattagttgcaaattaggtgagaaccagatagtgggagtttttcagtgtcacactaaggagtgtgtctttattgtacagaatacttactcttaaagttgggcagactctgagtgggaagaaaaatattttagcactgggtataagtgtatgtaacctgcagtctctttcatctttgcctctatgtttatagggtagtagtggtttttttttttttttgagacggagtttcattcttacgcccaggctggagtgaaatggcgtggtctcggctcactgcaacctccacctcctggttcaagtgattctcctgcctcagcctcccgaatagctgggattacaggcatgggccaccatgcctggctaatttttgtatttttagtagagacggagtttcgccatattggccaggctagtcttgaactcctgacctcaggtgattcacccgcctcggcctcccaaaatgctgggattataggcatgagccactgcgcccagcagtagtgtgtttttagggagggacagggaaggttgaaaaatggcactgtagaaagccatcagtaccatagcaattaaaccagcgttgtagtggttcaggaatagaaaatagatcagtggaacagaatagagaacacagaaatggattaataaatgtgtgggactttatatgacaaaaggtggcatttcaaattatagaaaaagtgtggaatattcaatatttggtttaatttccacttcacaccaaaagaaaaaaaatccaaatgcatgaattaaacagctaaatgtaaaagccaaaaactgtggaagtattagtagaaaatacaggagaataattttatagtcttgggagcaggaaaaactttctaaaacaagatacaaaatctagatactataaaggacaccctgttttccagcctctacattgactgtataaaatttgaaacataataaagatactttaaaaatgtttgaggcatgctagaacattaattcatgacccaacttataaggaactacaaatcagtaatgacaatctaataggaaagtgaacatatgaatatagatgcttcacagaaaaggagatgaggatagccagtaaacacaagatgcacagccccactgaagtcttcctggaagtgcagattaaggaatttattattttgctcatgagatgagcggaaattaaagatggttgttactctgttggtgggattgtggagaaataggtactttcatatgttgttggcagcaactttgtactacctttgggagagcaatttagcaatatctataattttttttgtttgttttgttttgtttttgtttttttgagatggagtttcactggagtgtgcctggcctttttaatttatttttgagatggagtctggctctgtaacccaggccttagtgcagtggtgtgatctcggctcactgcaacccccacctcctgggctcaagcgattcttctgcctcagcctcccaagtagctgggattacaggcacgcaccatcatgcctggctaatttttctattttagtacaggtggggtttcaccatgttgaccaggctggtctcgaactcatgacctcgtgatccgcccacttcggcctcccaaagtgctgggattacaggtgtgactcaccacccctggcctttttttttttttttttttttttttgaggtagagtatcttgtccaggctggagtgcagtggtattatctcggctcagtgcaacctccacttcctgggttcaagcagcaattcttgtgcctcagcctcccgagtagctgggattaaaggctcctgccactatgtgggcctagctaatttttttgtatttttagtagagatggggttttgccacgggccaggctggtctcaagtgatcctcccaaagtgctgggattataggtgtgagccaccacgccctactaatttgttgtatttttagtagagatgggtcttcaccatgttgcccaggctggtctcaaactcgtgagttcaagcgatttgcctgccttggcctcccaaagtattggaattacagacgtgagccaacgggcccggcctgtggcttttcgtggagttcttagaacgtaagttttctgtgctgttgtgccttctactttctctaccttttggaatgtcttcactttccagtcccttttacctagataatttgaattactctctgaaggctcaacctacttttcatgagttacagatatttgcttcttaaggatctttttttatcagtttcattttgatattttagatgtgaattcaatttggttgacagagtcttgctctgtcacccaggctggagtgcagtggcacaatcttggctcactttaatctctgcctcctggattcaagccattcttctgcctcagcctcccaagtagctgggactacaggtgcccaccaccatgcccggctagttttttttttttttttttttttgtatttttagtggagatgaggtttgcaccatgttggccaggctaatctggaactgtacccgacctgacagttgatctttttaatatttagcttagcttatctctaggtgtttcatccatagaactaaatctcagttgtgttcaggtacaaaaaagatggaaaactactcattcattcttcagaactgttttcaggacttcaaggaggccttccctaaccaccctatttaacattccagttcttgcaccatccccacccctactctgccctcacttttttctccatggcactgggcaccagctggctaactctgtcttcaaaaagtacttttctttgggggaggtttttcttttgtttttgttttctttctttcagtcctgtatcttcagcacttagaagagttcatggcacacagtaggtactcaataagcatatgttgaaagaatgaatgcagtttcatgttccggatgaggataggctcatttaaaatattttcatatgtttattagacaaaaagtagccttcaaaaaagttttcatgctgggcgcagtggctcacacctgtaatcccagcactttgggaggccaaggcaggcggatcatgaggtcaagagatcgagaccatcctggccaacatggtgaaaccgcatctctactaaaaatacaaaaattagctcggcatggtggtgcgcacctgtaatcccagttacttgggaggctgaggcaggagaatctcttgaacccggaaagcagaggttgcagtgagccgagatcgcgccactgctctccagcctggagacagagtgagactctgtctcaaaaaaaaaaaagttttcattagttgggatcttgtatcctcttccctttctcaagtgatgtgttttaaagcagacattttcatatcctttggcggaggtgaaagacccagaccttttgaaaagtattttacaaatacgttcttgaaagcactccagactgactcgcttatctttggtcacatgacagtacagctgcactttgaggcctttgcctatagcctattggttgccttacttcggaattgtagacgtgtgggagaataatgctcccattcttctccatcttatctagttctagaagatataatggtaatggaaacctcacctttttcatagtaaaatgtagctacccaggaatgatgaggggcaccatcatatcaggtaatattcattccagttatattttatgaggtaaaattgatactgttgttgtgttgttcttacagattttgacaggctccaccaaagtgtttttaaatgacttatttagcctctaactctcccctgaattcagtctccagacgcctactttatgtttcctcttggatgtgataataactatctcagatttaaaatgccccaaaccaatttgctggtttccttttcttcttctttttttttcttgagatggagtcttgttctgtctcccaggctggagtgccgtggcatagtctcggctcactgcaacctccacctcccgagttcaggcgattctcctgcctcagcctcccgagtagctgggactacaggcatccaccagaccacctggccaatttttgtatttttaatagagacagggtttcaccatgttggtcaggctggtcatgaactccttacgtcaagtgatctgcccacctcggcctcccaaagtgctgggattacaggtgtgagccaccatgcccggcccaatttactgattttcttctcataacctgctctttttgaagtctttctgcctcagtagctattccattctagtactcggtgaggccaggagtcatcctttataccccatattcaatacatcaggaagtcctgttggctgctgtacctttgaaatccgtgtataatctgtccatttctcactgtcttcactgccaccattctagtccaaaccaccatcatgtctcacctggattatcatagtagccatgcaaatgaacttcttgcttctgcctttgctcccccacaatgctgtcccagtaggtagccagagtgatcttttattccttttctcaaaacgcttctgtgacttttagttctcagagtgtaaagctaaaacgctttttaaaaggagtcttaggatctgtaagccctactcagtctgtccccttgccaccactctgtttattatcttgtgggtttttttttttgtttgtttttttttgagacggagtctcgctctgtcgcccaggctggagtgcagtggcgccatctcggctcactgcaagctccgcctcccgggttcacgccattctactgcctcagcgtccgaagtagctggaactacaggcgcccgctaccacgcccggctaatcgcccggctaattttttgtgtttttttgtagagacagagtttcactgtgttagccaggatggtctcgatctcctgacctcgtgatccgcccacctcggcctggagtgctgggattacaggcgtgagccaccgcgcccggcttatcttgtgtttaatcttttcctcctctctcctgctaggcgatccacacaggcctccttgctgtttctcagaggtagagctctgatctcagctttatagctactatttcttaaatgctcttcctccagttaactgtatataatggtgcctcactcattcaaatctttgctcacatatacttcagcaatgaagcttgccctgaccatcgtttttagagttaagcttctctatcccagcataaatctatcccagaataaatctcctcaaatattttacagggtttgactgtttttgtcgacataagtctaaggtttttgacctgaatgtgtggtgactcttgcttgtaatggctgtattgtttttggctactgcaattctgtgagttagcagaaataggagcagcaggaagatgatttcagtattgtagctgttgtgtgttaaacacttgagaaacctgcaaggggacatcaaaagcaattggaaatatatgactagagatcgagttaaagaaactactctgaggaataaaaggaagcctgagcctaaacagagcttcaagtttattgtcttcacaaagtattcttctttttataaccgtatgatttcttagcctttgtaactgtcctgtaaattctgcttatttctaaattactattagtaaagctcttaaaatggggagggtttatacatttaccaatggtcagattaatgggagaggaagctcatggatttctccagaattttgagttcttttttttttttttttttggaggtggagtcttgctctgttgcccaggctggagtgcagtggtgcgatcttggctcactgcaacctccacctcctggtttcaagcaattctcctgactcaggctcctgagtagctgagactacaggcgcacgccagcatgcccgactaatttttgtatttttagtagagatggggtttcactatgttggccaggttggtctttaactcctgacctcctgatctgcctgccttggcctcccaaagtgctgggattacaggtgtgagccaccgcacccagcctaattttgagttctgtaaagaacaattaactgcactatcacccagacgtggttacctttcttgtttattgattgcttaatatgtatttagcattcattcaatatgtgttgggaatacattataggctggtaaacaagcaattacagcacaatattctatattaagtgccagatgcagaaaataataagagtcttagggatggggtcaagggatggttctcaaaggaaatgaaccgttagctgagacaagcagaggagtttcggtggaggtaaaggggatgggcaactgatcagaatatgtaaagccctggagtaaagacaaagccaagcattttgaggggaactgagaaggttgggcaaagcgggaatgaattaaaagagatgagagctagagataaaatacttgatattcaaggctttggggcattatcttgaagaaaatcttaacattttaaaggaattacataatgagattatcatttgaagatctctagctataatggggaggttcaaactgccagggggctttcatattcactgtgtctaggatagggcttaaaaagttacttttttttttttcctttgattgtagtacacgcccaacattttgagaacagttgaattaatagggttctttagtaagcctgttagttttgcttatccaaattgtcatggtggtgttagggccagcgggaaatctttttctcttttgggctggatggtgttaccaaaacaccaggggtttggtctaggtcctgctgcttgccgcacagaaagccaatcacagagacgggtattgccagggaagaaggctttaattgggtgctgcagccaaggacatgggagatcagtctcaaatccatctcagtctcaaatccatctctgactgactaaaattagaggtctatatagcagagaagaaatgtaaccatgtgtgggcaaacaggaattagagaggggtgaggaagagaagttggtcaacaggcagcaggtggtcagttaagcaatcatgcaggctctggcttctcattgtccagttgcagtgatctgttaagtaagtttcagcttcttaatactatctaggaggcctgatggtttgtttcctaagaaaggagcttagataacacaaatagaactttctcaagttttaagactgtgaggatcaatttctgtatttattcagagaaaccataaagatcagttctgtgggataattggctggtttcaatgttatctttccttgaaggaagtaaacaaagcattaaactggggcctgattaaagtgggcttattgatttgagaaattcaagtatggtaagttgtcccaagtcagtaatgtattttacttttttttgtaatctgttagaagatgggagcaggcaaagggaaggagggaagctttcacacagtggagaaagaatgctttttaggcttcagccagtttttcttatcacaaagccctcacctacttcttgtttcatatagaattcttccagttacccagtcacttaaaccagaaacctgtgagctatcctacactttctcccttatatagttggttattcagtcctttaataaaataatctttaggctgtgtacagtggctcacacctgtaatcccagcactttgggaggccgaggtgggtggatcacttgagcccagaagtttgagaccagcctaccaaactagcaagaccccgactcttaaaaagaaattagctgggcagggtggcacatacctgtatagtcctagctacttgggaggctgagatgggagcatctacttgaacctgggagtttgaggctgtgttactggtggagggtgtccaggttcttggcatcttgaacaaagaactggacaaaacacacagacaaagcaaggaagggatgaagtcagagatttattgaaaatgaaagtacactccacagtgtggtggcgggccctagcgtaggggctcaagggcaccgttatagaatttgtgggggtttcaataccctctagaggcttccattggttacttggtgtataccctatgtgaatggagaggtgaagtaaagttacaaagtcatttacttggtgtatgccctatggagaggatatttcctgtcatagctgaagtgtgaatcggcctaatgttccctgcctccagaccctattttcccatctcagcaagccgtgttcatactactgtactccagcctgagtgacagagtgagaccttgcatccaaataatgataaaaataataaaataacctttcatgtcttctcagatctcttcaaaacccttcccgctatcttctaaaccctttccctcatcaacactggttaagttcagatgctcatatttttcatggaatattatgttgcttccttgcatcccacaggtctagggttgttgagttgcttccctatcttgaaaaaaaacatttttttgagacagggtcttgctctgttacccaggctggagtgcagtcatgcagtcatagctcactgcaactttgaactcctgagctcaaatgatcctcctgcctcggcttcccaagtagctaggacaacaggtgtgggccaccatgtcctgctgattaaaaaattttttttggtagagatggggagtctcactatgttgcccagcctggtcttgaacgcctggcctcaagtgatcctcccacctcagcctccgaaagtgctgttacaggtgcaagccgccactcttggccctgccatcttaatatatgctatttaatttaattaattaatttatttattttgagacggagtttccctcttgttgcccaggctggagtgcaatggcgccatcttggctcaccgcaacatccgcctcctgggttcaagcaattctcctgcctcagcctctcgagtagctgggattacaggtgcttgccaccatgcccggctaattttttgtatttttagtagagacagggtttcatcatctttgccaggctggtgttgaactcctgcccttatgatctacccgccttggcctcccaaagtgctgggattataggcgtgagccactgcacctggccaaatctgaccagatacaaccgcttatgcctgtcatcctagtactttgagaggccaagaaaggtggatcacttgagctcaggagtgtgaaaccaacctgggcaacatggcaaaaccctgtctttacaaaaaatacaaatattaggcatggtggcgcacacctgtagttccagctactcaggaggctgaggtgggagggtagcttgagcctgggaggtcaaggctgcaatgaactgtgttcatgtcactgccctccagcctgggtgacaaagcgaaatcctgtctcaaaaattaaaaaaaaaatcatggccaggtgcggtggcttcatgcttgtaatcccagcactttgggaggctgagttgggtggatcatgatgtcaggagatggagaatctcctggcctttagtagagatggtgaaaccccgtctctactaaaagtacaaaaattagctgggcatggtggcgcgtgcctgtaatccccgctactcgggaggctgaggcaggagaatcgcttgaaccagggagtcagaggttgtggtgagccgagatgacgccactgcactccagcctggtgacagagtgagactccgtctcaaaaaaaaaaaaaaaaaaaatcaaatctgatcttttaaactatatttgtactagattgtcttttttattttttatttttttaaagaactttcatattcttttacatttttctgcctttgtttttcctgtgtgatgctttttcctttttcactgggacatctttccttgtcatcagatcttttgattttttttttttttttttaggaatcagaaatcgttttgtttgttttttgcaatgttgcccaggctgatcttgaactcttggacttgagcggtccttccgtcttggcctctccgtgttggggttacagacgtgagctaccacacctagcccccccccccctttttttttttttttaaagagtcaaggtttcactgtattacccagtctggagtgcaatggcagttcacaggcatgatcattatggctcttaacagccttgaactcctggcctcaagggatcttccttcctcagtctcccaggtagctgggattaataggcactctccactgcttccggctccagaaatcttcattttaatgtagtatctcaatttttaaattttgacaactgttaatttactttaaaaaatgctatcaaatttgcagcctcatttatagagatttccttgatcattctcctttccccctgcaaatttaattgctcagtctttgtgtatttctgtcattgcataattttcaagctattataaacatgattctcatacaaatagacattgatacatatcataaacttttttgaaagtcctgaaaaatagtggaatgagaaattgggatttatatagtcagtttaggccaggtgcagtggctcacgcctgtaatcccagcgctttgggaagctgaggagggcggattgcttgaggccaggccttccagaccagcctggccaacatggccaaacgttgtctctacaaaaaatacaaaaaattagctgggcatagtggcacatgcccatctacttatggggctgaggcaggaggatcgattgagcttgggaggtcagggttgtggtgagccatgattacgccattgcactcaagcctgtatgacagaacgggaccctgtcacactcaaaataaagaaaagaaatatagtcagtttaataaagaatgctgaaataaaattgctaagatataaacgtggttaatatcctacagggtatttaaactgtagctttttggataacctctactgactggacagaaaaaatttattttaccgtagtagttttctgtaagtttacttttaaatttgtagagttataaactgcctgggccttaattgaaattagaaataaaacaattagatgacctcaggtgagcctattacaaaatgctcttgtcataacattaaaagtcatacaattgataccttatttcaggttttgaataattcatttgaaacatgttaatttttatactattagcgaccaacctttttgtatcctctctttttgaaatattaatgtacaggagttttcagaataattaacagattatatagatctgacttgaggctaggagtttgagaccagcctggccaacattcgcaacgagtgaaacctcgtctctactaaaaataccaaaaaacaaaacaaaacccccaaaaacagattatatagatctgtatttttgccctgttctcatttgagcactagttccatattgtcttcagtagagttctattagaacttggatctaatgtgttcacagtatatgtccaataacagaagcataagacacatgtagaataaatcagtaggagtactatttgctttactaagttgggttttgaagtttaaaggagtttcagatacaaaaagaaaaaaccaggtggagtgaccattgtatgctggcttagggcttgagtccaggttgttgccagtgaccagatgtttgtaaccaacctctggtgtcttcccccctgccccaactttaacacaactgaagtattgctgacacagttattttcataaaaacagtttgattgccgggcgcagtggttcacgcctgtaatcccagcactttgggaggctgaggcaggcggatcacgaggtcaggagttcgcgaccagcctggccaacatagtgaaaccccgtctctactaaaaatacaaaaattagtggggcgtggtggcacgcgcctgtagtcccagctactcgggaggctgaggcaggagaatcacttgaacccgggaggcggaggttgcagcaagtcgagatcgtgccaccgcactccaaccggtcgacagctcgagactccgtctcaaaacagtttcatcatgtttcttctatgtttgaaaatgtaaattacttcatgttgccaacatacagacttcattttcttggcataggagcttttcagtttccctgtgcttctcagtttctgcagtcatgtttttcacaccttactgttcattgaaaatagagtcctttactgttgctgcctgctccccattcacgattatccttttccttcacctctgtctggccaaatgctacattttcttttagacataactttctccttcattccaacaatataactgttgagactgttctagtccaggagggtctccttatcttagaagtttgcttctatctgttcatacaggtatgcagtcctgtcatgttctgtatggtaaatctatgggtggcttgtctctgtttcacctggaagacagtaaaccacttttcaaacttagtgtcacatatagtgcttcctatagaattaaaaaaaatgtgtctcatgagtcaatatgtttttgtatttgtagacctgaaagatgtctgaaaattccagtgacagtgattcatcttgtggttggactgtcatcagtcatgaggtatgatatttaatactttttataaggtaatttgtaatattaatgttaccagtgatgtaaactgtgttctttgaagatcagtctttttctacctttaagcaaaaagttccaatggacattttccctctcatattaaacttcactgctgaaaacgcttcatgagccagcatcttctacattattgtacatagctttgagacattaggcaaatatttattgaaggtttgttattgttcaggccctgtgctttactttcattttcatataattttgtctttttttttttttttttttttgagacagagtctcactctgttgcccaggctggagtgcagtggcgtgatctcagctcactgcaacctccgccccactggactgaaatgattctcctgcctcagcctcctgagtagctggaattacaggtgcctgctaccatgcccagctaatttttgtattttcagtagagacgagtttcaccatcttggccaggctgatcgtaaactcctgacctcgtgatccatctgcctcggcttcccaacatgctgggcttacagatgtgagccactgtgcctggccaattttgtctttttttttttttaaagggacaggatcttgctctgttgcccaggctagagtgcagtggctgttcacatgtgcaatcatagtaccatgtaacctttaactccttgggctcaagtgatcctcccaagtagctgggactataggcatatgccaccataccctgttcttaaataattttgaatatttcactgtgatacatactgttttcattcttattttatagttgagaaaactaaagcttagagaggttaagtaatttggtcaagattatgcagctagaaaatagatcctggatttgaacagatcagaaaggagaatggagaacatgtgttccatttacgttatagcagaacttcacagggaaaaggccagaaccctatcacaaaatgaattttataatagaagattgatatacatacaacaagtatacataacttgtacattttgtttattttttcataccagtaatatatgttcactgtagaaaaatggcagtatattgataaacagaaatatacttactccaggttttactccaggttttaatggacatctataattttcccatttgtttttagggtattgtaagcctcacttgttttctttttttcttttttgagatggagttttgctcttgttgtccaggctgtcgctcttgttgtcttgtacagtgacgcaatctcggctcacagcaaccttcgcctcctgggttcaagccattctcctgcctcagcctctggagtagctgggattacaggcatgtgccaccacgcccgactaattttgtatttttagtagagacggggtttctccatgttggtcaggctggtctcgaactcccgacgccaggtgatccgcccgcctcggcctcccaaagtactgggattacaggcgtgagccaccgtgcccggccacttgtttttttaataaaaattataggccgggcgtggtgctcacgcctgtaattccagcactttgggaggccgaggtcggggcagatcactgaggtcgggagttcgacaccagcctgaccaacatggaagaaacccggtctctactaaaaatacaaaattagccaggcgtggtcgcacatgcctgtaatcccagctatttgggaggttgaggcaggacaatcgcttgaacctgggaggcggaggttgcggtgagcagagttcgtgccattgcactccagcctgggcaacaagagtgaaactgtctcaaaaaaagaaaaaaaaaattaaaaaatttttgttttttaaactattagttaaggttcaggtagttatgtttagaaaacattaacagaaaaaaacaagattgccttttctgcattaaaatttcaaaatttaaaagcatctatcatttgagattgagatgattcttctttttaaaatcttcagtgacttttctatttttagcttgttttcttcaaaggattagatcaactcccatagcaacttctccttcaaggataattaacaatataggagcaaggcagctatgggagtcttacctgttagtctgcagggtggagtatgacagcagacctctgtctggcactcagtcaagtgtgtcattagggtgttctgtactggatgttatgtcccagattgaatcatatttgtacttttatctctcttcttctatatctgctttccaggttctactctttcttgctaatttctcttacatgtgtctccttttcctctcccattactgccattctcatttgggccagaattggtttccccagcaattcctaatacataaccttgctttagcctctaccattctcctgccactatagacaacctcggagtcttgcattccgaattctcattagggctcaacttaaacgctacttttttctttacttttttttttttgagatggagtcttgctctgtcgcccaggctggagtgcagtggcaggatctctgctcactgcaagctccgccccatcggttcacgccattctcctgcctcagcctctggagtagctgggactacaggcgcccgccaccacgctcggctattttttttttgtatttttagtagagatggggtttcaccgtgttagccaggatggtctcgatctcctgacctcgtgatccgcccgcctcaggctcccaaggtgctgggattacaggcgtgagccactgccccggccctacttttttcatgaattcttttaatttttgctgtcttgagttatgtatacgcaagagaatgcagacctttcgattccatgtgtcagcagactatagtggggacatagggaaagacggaatcaccttagtggttaactttgttttacaattaagacacaaagaaaaattgtatgatccgctattattaatgaaaagacagtctgacatcaaagtaggaaagataacctcagaataaaaagatagtctaaaattgtgtgaggagagtattcattaaccctataggtttatttaatccatgtcattaaagctttagccatttttagtttatagtgccataataagtagttatttgcatatgggtgtttctctgaatatgttgtaaaattgaattttggatttcattttttttttttttttttgagacggaattttgctttttttgtgatccaccggcctcagcctcccaaagtgctgggattacaggcgtgagccaccgtgcccagccagatttgaattttttatatcccacagcatctagcgaagtgccttgtctagagtagttccataaatgttaagtagaaacaaattattatagaaataaccaaatttagacccttattctctggaattcaaatttattgcttgagctcataaaatagagcattccacttttgggctgacctgacttagaatttaaacctgagactccattgtgccattttcctgccataggcctttgtggactaaattgaacaaaagcttgtctaattagatactgttcctttggagtatggcagcatctgagacttttaataatggaagaagcatttacatgtagtcaaatctagctttgaggagctaataggcaaataactgaaagattatcacttttccttaggggtcagatatagaaatgttgaattctgtgacccccactgacagctgtgagcccgccccagaatgttcatctttagagcaagaggagcttcaagcattgcagatagagcaaggaggtaagttgttcacaaattctaattttttttttaatatgatatatgagtgatattatgagtcttgccttctttccaggtgggtggcctttctggctaatctaaggggtcgttggaggattagaacttcagtgtaggttgggcacagtagctcacacctgtaatcccagcattctgggaggctgaggtgggcggatcatttgaggtcaggagttcaagagcagtctggccaacatggtgaaaccctgtctctactaaaaatacaaaaaattagccgggtgtattggcaggtgcctgtaatcccagctactcagaaggctgaggcaggagaatcgcttgaacctgggaggcggagtttgcagtgagccgagattgtgccattgcactccagcctgggcaacagagtgagactccatttaaaacaaacaaacaaagaaaaacttcagtgtggatttggtgaaggcccacagaacccagagtcatcagcctgccccaggggtttatttgcagctgtagtatatttttgggttttcagatacactttgttgctacagaggtaaccagtgacaaaaaaagtgtttcatggtttaatctgaatttgtttggtagtttctatttccttgtcatttgtttggtagtttgtatttacttgtcattattaaagttaagaaaaaaattattcattgatcacaagagatttactaacctgttttccagttattatcatgttgatggagttacagacatgcctctcattttattctgctttgctttattgtacttcgcagatactacattttttacaaattgaaagtttgtggcaaccctgtgttgagcaagtctattaatgccatttttccgatagcatatgcccacttcatgtctctgtgtctcatttttataattataatatttcatttatttttattttattttattgaattgaattggcggagtttcgctcttgtttcccatgctggagtgcaatggtatgatcttggctcactgcagcctctgcctcttgggttcaagttatcctcctgcctcagcctctcagctgggattacaggcatgcgccaccgtgcccagctaattttgtgtttttaatagagacggagtatcatcatgttggttagcctggtctcgaactcctgacctcaggtgatccacctgtgtcaacctcccaaagtgctgggattacaggcgtgagccactgcgcctggcctgtaattgtcatatttcaaactttttcattattattacatcagttatggtgatctgtgatcagagatctttgattttactattgtaattcctttgggacaccatgaaccgtgcctatgaaagacagtgaacttaataaatgtgtgtgttctgactgctctactgacttgccattcccccatctctctccctctcctttggcctccctgttcctggagacaacaacaatattgaaatcaggccaattaataaccctacagtggcctccaggtgttcaggtgaaaggaagagttgtgtgtctctcacttcaaatcaaaagctaaaaatgattaagcttatttgaggaaggcatgtcaaaagctaagtctcttgggccagatagttagccaagttgtgaatgcaaaggaaaagttcttgaaggaaattaaaagtccttcttagtgaacacatgaatgataaggaagccatatagccttattgctgacatggagaaaattttagtggtcttggtagaagattgaaccagccacaaaattcccttaagccatagcctaatccagaacaagtccttcctaacttgcttcaagtctatgaaggctaagagtggttaagaagctgtagaaagaaaggcggaagctagctgaggttggttcatgaggtttaaggaaagaagctatgtccgtaacataaaagtgcaaggtgaagtagcaagtgctgatgtagaaggcgcaccaagttatccaggagatctaactgagataatggatgaaggtggctaccccaaccagcagattttcagtatagatgacacaactttctattggaagaagatgccatctaggactttcctaactacagagaagtcaatatctgcttctaggcttcaaagaacaagctcactttcttgttagaggcaaatgtagctggtgactttaagttgaagccagtgtttacttaccatgccttgagaaatcctaggacccttaaaaaatatgctacatctactctgcctgtgctctgtaaatggaacaacaaagcctaggtgacagccatgtgtttacaacatggtttactgaatattttaagctcagtgttgagacctgctgctcagaacaaaaagattcctttcaaaatactagacattgtatagcaatacctggtcaatcaccgaagggctctgatggagatgtacaaggagattcatgttactttgtttcctgctaacacaacatccagtctgtagtccatggatcaaagagtagttttgactttcaggttgtattatttaataaatacattttgtaaggctgtagctgctatagatagtgattgttctgatggatctgggcaatgtgtgtgaattgaaaatcttcaggaaaggattcaccattctagatgcctttaagaacaattgtgatttgtgggaaaaggtcaaaatatcaacattaacaggagtttggaagaagttgatttcaaccttcatgactttgagtggttcaagactttaatggaggaaggaactgcagatgtggtagaagtagcaagagaattagaattagaagtggatcctggtcgggtgtggtggctcatgcctataatcccagcactttgggaggctgaggtgggcggatcatgaggtcaggagatcgagaccatcctggctcacacggtgaaatcccatctctactaaaaatacaaacaattagctgggcgtggtggcaggcgcctgtagtcccagctactcgggaggctgaggcaggagaatggcgtgaacctgggaggcggagcttgcagtgagccaagatcgcgccactgcactctagcctgggcaacagagcgagactctgtctcaaaaaaaaaaaaaaaagaagtggatcctgaaaatgtgatccaattgttgtaatctcatgataaacttgaacagataaggagttgcttcttatggatgagcaaagaaagtagtttcttgagatgcaatctactcttggtgaagatgctgtgaatattattgaaatgacaacagaggatttagaatattacacaaacttagttaataaagcagtggcagggtttgagaagattgactccaattttgaaagttgttctactgtgggcaaagtgctatcaaacagcattgcatgctacagagaaatctttcatgaaaggagagtcaatccatgtgggaaacttcagtgttgtcatacttcaagaaattgccccagctactccacccttcagcagctaccacagtggtcagtcagcagccatcatctttgaagtaagactctccaccagcaaaaatattacaattcactgaaggctcagatgatcactagcactttttagcaataatgtatttttaaattaagatatgtacagttttttagacatgatgttattgcacacttaatagattacagcatagtgtaaacctaacttttacatggacagggaaaccaaaaaattcatgtgacttgctttattacattggtttggaactgaacttgcagatatctgagatatgcctgtactctggttccaatctggtaaaatggaatctgtattatgtatacttcacatgggatttgatgcacacattatttatatagagaaataggactcctgaacaattactgcatacacttatgttcatatttaaattacttcattaactttttaaaaaaattacagtaaaatgcatacagaacatttcccctcaggagaaaaaagtggatgtgtcaaggccagaaatagaagagattatagctgttaatttttttaagcctacacgttgattattactactctcatttgaaaagtgattctcatcttttttgtgtcagagatccttttgagaatctgaaagctatggacagtttcttccaagaaatgcatttacttgcatatgttaaagaaaattttcttttttttctttttctttatgagacagagtctcgcactgttgcccaggctggagtgcagtggcgcaatgatctcagctcactgtaacctccgcctccccggttcaagtctcagcctcctgtgtagcttggattacaggtgcctgccactatgcccagctattttttttttattttttatttttagtagagacgggggtttcaccatgttggccactctggtctcgaactcctgacctcctgatcagtctgcctcggcctcccaaagtgctgtgattacaagcatgagccactgtgcccggcctaatttttttgttttttgagatggtgtcttgctctgttgcccaggctggagtgcagtggcgggatctcggctcgctgcaagctccgcctcccgggttcacgccattctcctgcctcagcctcccaagtagctgggactacaggtgcccaccaccacgctcggctaattttttgtatttttagtagagacggggtttcactgtgttagccaggatggtcttgatctcctgacctcgtggtctgtccgccttggcctcccaaagtgctgagattacaggcgtgagccgccgcgcccggccattttaatagcgacgggatttcactatgttggtcaggctggtcttgaactcctgacctcgtggtctgcctgcctcagccgctcaaagtgctgggattacaggcatgagtcaccgcgcctggccccagcaccccggccgagtactgtggcggaatctcacctctaaattaattaattttctgttagagggtatataatgctgaaaaatatttttttttccctgttctttgcaggacttaaattacataagaaatgcatgatcgaccgggcgcggtagctcatgcctataatcccagcactttgggtggccgaggcgggcggcttacggggtcaggagatcaagaccatcctggctaacacggtgaaaccccgtctgtactaaaaatacaaaaaattagccgggcgtggtggtgggcgcctgtagtcccagctacttgggagcctgaggcaggaggatggcgtgaacccgggaggcggagcttgcagtgagccgagacggcgccactgcactccagcctgggcgacagagggggactccgtctcaaaacaaaacaaaacaaaaaaaaaacaaaaagaaatgcatgttcatgatagggaaaaaaaaatagtaagcaaaagaaatttaaaatggtctataattcttttatctagaaataattactgttgatatttggtgtactttgctcataaatttatatgttatattatttttaacttttcttaatattttatgctcttttctttttttttttttttaagacagagtttcactcttgttgcccaagctgtagtgcaatggcatgatctcggctcactgcaaccttcgcctcctgggttcaagcaattctcctgcctcagcctctggagtagctgggattacaggcgcgcaccaccacacctggctaattttttgtatttttagtagaaacggggtttcaccgtgttagccaggctggtctcaaactcctgacctcaggtgattcacctgcattggcctcccaaactgctgggattacaggtttgagccactgtgcccggcctttatgctctttttcattaaaaatatattgtgaagtcatcattctgtttgtacacattttctttgaggaggttcttataaaatatatcttctgtagtgacatttagtttttctgtgttttgagttctttcttttttaaaaaaaattattggtagaactggtctcgctatgttgcctaggctggttttgaactcctggctttaagtgattctcacacattggcctaccaaagtcctgggattacaagcatgagccactgtgcctggactgccctctctctgacttttttttgagacatagtcacactctcttgtccaggctggagtgcagtggcatgatcatggctcactgcagcctcaactcctaggctcaagtaatcctcctgcctcagctttctgagtagctagtactataggcacataccaccatgcccaaataattttttaatttttatttttgtagagacagggtcttgctgtgttgcccaggctggtcttgaacttgtagcgtcaagcagtcctccagccttggcctcccaaaagtgctagggtgacaggtatgagtcactgcaccccgcctgagtccttgttttttatagtttatgttttcttataaggcatttagacacacacacacacacacacacacacacacacgtacatatacatacatactttcataaatcatagtttgaagccacggtttttattcttacggtaccaggcattgacagccattagaatggtctttagaaacttcgaataaacttttaagaattcaggaaatgtatcactaggtatctaatgatagattttttcatattaggtattaatgaacatactggatcaagtaatttggtaatgtaaggtagaggttttatttacttagtcaaggtagctttgagttcttaataaatcttgtggctgggcacgatggctcatacctgtaatcccagcactttgggaggccaaggtgggcggatcgcttgaagtcaggagttcgagaccagcctgggcaacatggtaaaaccctatctctagtagaaatacaaaaattagccgtggcgtatgtctgtaatcccagttgcttaggaggctgaggcaggagaatcacttgaacccaggaggcagaggttgcagcgagccaagatagtgccactgcactccagcctgggcaacagagcaagactccatctccaaaaaaaaaaaaaatcttaaatgattgcattttcttatccaaaattatcacctgacagtttcaaataaatgaagttcattagcaacagtggagtgacttctataattgtatgtgacatttcattaaatctatcctaacatattaggaagagatttttatctacccagattatatgttggctgcagaaagtcaacagagagttttaaattaagaaataattatattgatctttgctttatatcagaaagcagccaaaatggcacagtgcttatggaagaaactgcttatccagctttggaggaaaccagctcaacaattgaggtaaacttgtattttacactgtggatatatgttaaatagtatccttagaatactatttaaagcctctaattctatttatgcattctattcctattttgaattataagcaattttgacttctaagttagatgtcttagaggacatctaagcaaagtattttattggtattgtgttaaagatctatcttttcacctctaatataattctttttggaagtagattgcattcttgaattatattgaaaaattaaactgttaggtttcatgtctaaaatggtggttcattttaaaatttggtaacaacctgagacttatgctttggggttttacttgacttctgtataaaactagatagctagatgatcattttacatggtgttttagtctgtactgatctgacaaaatacctgatactgggtgatttataacaaacagaaatttatttctcacaattatagaggctgggaagtttaagatcaaagtgtggacaagttcagtgtttgctgatgacatgctgtcttgtttccaaatggcattttgttgctacatctttaagaggagatgggcaaaaaaaggctggatgctgcatgaagcctgttttataaagaccttaatcatattcctaggggaggatcccttataactcagtcacctcctaaaggtcccacttcttagtactatcacattggcgattacattccagcgtagaaatttgtggggacaccttcagatacattcagtacaagatacagctgttgaagtttattacgtacataacctaaaaagttcagtgagtcttttttgggcttccacactacagagttgtgctcgaatagaaccatggaactcgtgagagaagtgagctcttttttctgtggttattgagggggcaaagatgggcttctcagcttctgcagcccactaggagaatgcagtggtctgatctaattctgagagttgtcaagggatctgatggtgttctcaagctatatgatgagcctgctattgcataattctttactaatagtaggaatcatatcttttattttaactcagatgactataatacttactactgttgtattctaagaaaatgtaagacccttaaatgattgttgaacttaccatctctaaaattatgattcttcaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactggtaagaatacactgataagagacttaaagacatgtacgaccacattttatataaaggcttgttttctacccctaataatttagtctctagttttgaatatgtttgggtaaaactcaagacaagactatttttgtgtgtgaaatctattaatacctagtgtttcgctagactgttctggagcatagcaatcttttactgtaacagtaaccatcttttgccattaaatagaagacaaaattgcttcagtgagatttgttaaaatcacaaatgctccaaaattcttttggtgctttttagatctttaagagtgggagattggggatgttaatatttttgcttgcagtagtgtacattttgtaatatagaaatagtgaaaaaaattgttattaaagtctcttcagatatattcaattattaatcatgcaacaaacatttattgagtacctaccatatgtgaaacagagttcaaggtgctatcaatacagctagtcttccaaagctcgtgaccttcagatcttttgttttagattctgttatgaaaatgtcactagtgtaagccacatttttaatgcaatcaatgcccgttgtacagacagactcattcagagattaaagtgtgagttgcttgatttctttctgctatgcttcagctcagttttagcagtatgtataacatcttttaatgtgatgtaagtatgtaggtataaagttcctggatatatcagttattaagccacaattataactaagcgtgagttatggcagagacaacttgaaacactgctagtgattctaaaaatttcctaatttgacgaagaaacaggaaacaggtagtatctattttagataatttttttagattttaccattctttaatatttacatttgccaaccagaatcagacaatagaatttctgtcattccagtttaagctaataaaatgtcaagtagaggttcttggctgggcatagtggctcatgccagtaattccagcactttgtaaagctgaggcaggtggattacctgaacccaggatttcgagaccagcctgggcaacatagcgagacctcatctctacaaataataaaaagccaggcatgatggcgtgcgcatgtggtcccagccacttgggaggctgaggtgggaggattgcttgagcctgggaggttgaggctgtagtgagctgagattgcgccactgcacccagattgccaacctgggtgacagagcaggatcctgtctcaaaaaaaaaaaaaaaaagtagagattcttggctatctcatttaatgagaagttattttcagttagtatatcagtggtttgcctataaacatgaacgtgaaaacactttttccagctatttgaatattcatgtgacattcttgatgttcagaggaaaacttcaggctttgttagaatagcattcatagtatctttatttatggaggggtattgtaattgattttagaatccttgttagtcatcaaattttattattatttttttaaactccaggatttgtgttgtattcaggtagtttccccacccccgcttcctttcctgcctctggtttaattagagaatattcatggcccagaaaagtcaaattgaagccagagtattatagaatggtcagatatataagaaactgacatagacgtaaaaggaactacatactgttgctgggcgtggtggctcacgcctgtaatcccagcaccatctcaaaaaaagaaagaaattacatattaacttttttcaggaagttgtatagttctaagaccattcttctaatatttatcttctttctgaattctgacttcttgagatttttgtggactaagaggaatatttgattaactgtatttttacccattgttattcctcctaaagatattgtttcaataaaccaaatgtttaaagacgaaattttggactatactgaaaacactgcatataaaccagttgccaaaagtttttgttttggggccgggcactttggctcatgcctgtaatccctgcactttgggagactgaggcaggcagattacctgaggtaaggagtttgagaccagcctgaccaacacggcaaaaacccttctctactgaaaatacaaaatttagccaggtgcctgtaatcccagctacttgggattagctgcctgtggtagcgcaggcctgtaatcccagctactctggaggctgaggcaggagaatctcttgaacccaggaggcggaggttgcagtgagccaagattgcgccactgcactccagcctgggcaatagagggagaccccgtctcaaaaaaataaaaaagatggtttttgtttttcccttttagtttgttaattttgtgctagccattgcttaattttgttttttcctttccctttcttcatccttaaggatttcaacttcaattttttcttctcctgacttatattcttgtggcagtgtacgttttgttgggttaagaacactgcctgcttcctctttatgaactctcttccctgacaaaaagcaaagttggtagtgtagagaagtttgtattgtgtgtttttaagaaggcatggttattacgttttaattttgtacggataacaatgttaagtgataattaagtatttttaattcttttttttctttttagtctttataatatagctttatgcctctttttttcctgtttattcacaaaagaaaggtggtgggagaagctgtggaagattcctgagtgcatatggggatgggatgatcagctgaaacaccatgttcctagccaactcgctttccaaggtggtgtgactaaatctgaccagcttctctagagctgagtgtgcctagtcacatttactatttaccgagtgctttaaagatacctgttgtcatccgcaatactctaaacaggtgttcagaatctcttgtaaaggagctggccaagcttattgcatgcctttgcattgcttgcatctatgggccaaattaagcttttttaaaagaagttaaaaatcaaaatatttcagctattatatgtatgggttaaaaaagttggaagcattagataaggacatgaatatattaatgtgggttaggctgttttgttagaatatataatgaaggtaatgttaatgtagaattgaacaattatttaaataagttttacaaatggtttgtttttacatttacctatcttaattttatgtcagaaagcctgacttaaatactctaaccatgatcatgaatgcctttgtattatgtaatgctttgtttaagtcttcctttctttctctttgtccaagaaatataatctcacacctgaggcgacggcatctttgaaaaactagtgatcaagaataaccagataaacatgatgggcataagggtcatgaccaaaaagatctctcagtggcatctgtatcactaaatattaggaatattcattcatttcagtagtgccttctgtctttgtgtttattgttgtaagtgtgaaagtgaactgaatactccatgatccatctctgaaaaatattgcctaacctaaatcaccagctttcctgtggcatggatatcctgtcttctgaagaactgtttttgcttttctggagcatgaatgtttgttgttttagagctctttgtattcgagttcatattttatccttatttttagtgcttttcctctaagtagcttgtggaaattatttctgagtaattgaagcttctgtgtcaacataatagtttgttgacataagaaacagtgttaagaaattatgcatttggaaaaaactgaaggtgattttttccagggaatttgtttcctggacttgggatttcttgtgcaaattttccccactagtttgtttttctctactattattttcataaaggagcagcaccagaatagtccttaatatcggagatagctgttgtgtcacttcctcatgctgacatatttactagagggtaaaattaataaccttctagtaagagtggcagtcgaagggaagggctcatctgacttctggaaacctatgttaaaatacagtgctttgaaccttgatcatgggctaattaggttggaaatgaaactagagaccagatacacccaaggaaacttttggtagttattttactttataagtcacaggaaatgcttgtgtactttcctgtgttccttaaatagttgcacttaaattacctctttgaaactgaatgaagagacagagagtattttttttctttccagaaataatacttgtttatacctgtaatagcaatgaaattttgtttcttttgagacagagttttgctctgtctcccagtctggagtatagtggcaggatctcagctcactgcaacctccacctcccaggttcaagtgattctcctgcctcagcctcccaagtagctgggactataggtgcactaccatgcccggctaatttttgtatttttagtagagaaggggtttcgccatgttggccaggctgatctcgaactcctgacctcaggtgatctgcccgcctcggcctcccaaagtgctgggattacaggcgtgagccactgctcctggccagcaatgaaacttgaggctatgcgaatgaaggattgttctaagagtgtaaactataaggcgaggaggattaaataaaaaaacagagataggctctcaaagcaccaaatagtatgattaacagattcttgtgtatcacatttgaaatgctttatgttttggctttatgttgatgagttgaaaacccgtgtttttgtttatgttgtttggtttttgtttttggctatcttatgtagaaaggcatgtaagggatggcattgattattctaaataatttttactgggaaagcttttccaagattttgaatagctaaatgtcaacttttttcttaatagtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggtaagtactcaaaaatgtgttatacataacctgatgggatagtgtagaggaacttaagagtgaggactcttgggatctgttttcagtgccattattaaatgtgtggccttgaaaacttgaagcctgtttgagcctcagttttctcattcgggaagtgggtgctgcctatctcacaaagctttttatttaaataaggtagtagttattaagaaatgtaaggataataaccatatatgtttgtgactcttttaaagttaaaagattggaagattaaaaatctgaaatgctcaccatgaggcaaatcatttacatttagaatcacacttaaactaagttgaagtgtgactttattaggaagattatttaaatcccagttgaaatagttacatttgaaatgtgtaaataataagtgttcattatttctactttgaggtttcatgtaagtatcatactttgtaactttcattgttgcttctgtgattcacatgaattgagagtttgtcatctttgttcttatactttgctctttattatgattgatactgtttatatatgttgattatcttatcaattcaaagcttttaaatgccttttgggtgagaagaggaaggtattctattggtgttactttactttttcatttaggagcctcacccattgactctctcctttgttttttggagacggagtcccactctgtcgcccaggctggagtgcagtggcacaatctcagctcaatgcaaactccactcccagggttctagcaattctcctacctcagcctccggagtaactgggataacaggcgcccgccaccatgcctggctaatttttttatatttgtagtagagacggggttttgccatgttggccaggctggtctcgaagtctttttttttttttttttctttttttttgagacggagtctcactctgtcgcccaggctggagtccagtggtgcgaccttggctcaatgcagcctctgcctctgggttcaagtgattctcctgcctcagcctcctgagtagctgggactacaggcgcctgccaccacgcccagctaatttttttgtatttttagtagagacggggtttcaccatcttggccaggctggtctcaatctcctgaccttgtgatccacccgcctcggcctcccaaagtgttgggattacaggcgtgagccaccgcacccagccagtcttgaactcttgacctaaggtgatccaccccactcagcctcccagagtgctgggattataggcatgagccaccgtgcctggcctgagtctcttatttaaggtatgtgtttgtacaatgactggagtatttgaaacctgaactttgactctctttgctatattggaatttggggtagagacactttaaaaggaaatgtcttagatcttgtcaacttcccaaattttagcttgctttacattaactacttttagatttttttgcctgcataatccacagtcttaacttttcgttttgctagttcattcgaaaaatgtatttcttatgcaaagattgaagaattacatgtaccctatgtggatttgtggaaaaggtatattattcaacatagcgtaatgttagaataaacttaatgaagacaatacctgtttaaagtcagagcttgcaagatgtttcttgtatttatattaataaaaatatgtatttagatttctgatggatacctgcttgaatttaatactgagatactattatttgtatcctttcttgaaatttgttgtaataagatttgatttgaaatatatatttacctttatagactatctagctgaaacaatcaataagtatttgagtatgattttccctccacaagtaaacatgagggtaacaatggagaagatcttatcttaatctttttttcttacttcaaaaaaaattggatagtgatttaaagtgttaatccaaattgcattaaaacttcaccatttacatgacctttgaatattttgtagaaaaataattttacagaagtgctttcaaaatgagaagttacttctctgttatgtaggattttggttattagtaaaatttaccttaatagttaattaataaaacattgtcctttacttgatattagccttttcaggctatgaaaagcctggataacatattatgaagtaggcctacatagtaatgagattagttgaattaacatacaagacctgacctaaatgacttttccaagtcactacttaaaagacatcacttttttttttttttgagacagagttttgctcttgttgcccaggctggagtgcagtgcgtgatctcggctcaccgcaaccttcgcctcccgggttcaagcaattctcctgcctcagcctcccgagtatctaggattacaggcatgcaccaccatgtccagctaattttgtatttttagtagagatggggtttctccatgttggtcaggctggtctcgaactcctgacctcaggtgatctgtccacctcggcctcccaaagtgctgggattacaggcgtgagccaccgcacctggcaagacatcacattttttaatttcagcactgatctcaacattctttggagttgatttcagagccgttttgaattttctattcaccgtaaagtcggtcattgcatcccatagtcattcattcactttataattttatttttttttgagacagagtcttgctctgttccccaggctggagtgcagtggtatgatcttggctcactgccacctccgtctcccaggttcaagcgatccttctgtctcaccctcctgagtagctaggattacaggcatccgccagcacgcctggctactttttgtatttttagaagagatgaggtttcgccctgttggccaggttggtctcgaactcctgaccttaagtgatccgcctgcctcggcctcccaaagtgctgggattataggcgtgagccaccgtgcctggcccgctttataataatttaacaataccatattactaattgaatcattctgcgtttgccagccctggtgccatacagatttgaattggcagatctatactgcagggaagagaaagctagcatgactaaggatagtgaggcagtgtactccaggtatttggttctgaaaatgcttccagaagttttattaaaaagtttcatgagaaagcagtctttcttattcttacatttgcttgtgactatcaacattccaaatcatcaatggagttcaattgatttggttttctcctcgagttgctttaagtattgatagactacccggctcttcggcagactattatataacaagatatctagatgctaagttatagagcacagaatgaattacagctcaaagggtacacttactgaattatcctggaggtggtaagatttaagttgtgtctaatcatagtaagtttatgatagactcaagggaaggtggaacattccagcgacagagaatctgataacctgaggaagacgtaatcttgggtttgggagcagtgaaaagactgcttggactacagcagagtgtaggtatttagaaataatggaataggtggggtgctattatagtcatcccttgatatacatgagggatgggttccaggatgcacccccataccaaaatccatacgtactaaagtcccttgactgcggacctcacatatatgaaaagtcacctctccatatacctggattttgcatcctgccatgtagttcaaactcatgttgctcaagggtcaactgtgtattgtaaaacgtcttggaatctagataggaaagtttgatttattgagtaacctgctatcaggttagagaaaaaagtgccggaactttttgctggtgtggaaaaggtggtatggaaaaatgtagaatagtcagtcagttaagagttctgtaatctggatatttggtgaggaggaccttgacaattggaataacagtgggaatggaataagggacattgaaggaataatggaaaataatggcaatttattaaattgtagaaaatgtgctagctgcttcacttttggagttggggttactggggaagttttgccagatgataaatagatggtaagcacagtttggtttggttttacccaaatttgttctagacaaatttggtttggggcaggtgttgaggtttgattttttttttttttccaccctacaaacaggccccctacacagctggatgtgttggctagaagctctgatgagaagttaggacaagatctgtagcttggaattcttaataggagtgatagcaaaatctgacagcgctgcaacatggtaaaataggcagcatttgtagacatgactaggccaaagattgtatcttgaggataagactttaggtagctgaaggtgcaggaaaaacccccaagtgattagtcagtaatattgtaaaaggccacattaagacagtaatcaagcatatgctatattatactatcttgaattcagacctcaacacagttttagattattttccagtgggcaaaggaattaatctcagcagtttgaaatagaaattgcagaagttttctgttactctgggaactatagataaatttcaacatttgaaaaaaatctgggattctgctgagtaattttgaaacaagcttgccgtgcttctataaattgagaaatctaaagagaggaaatgaattctaacacagaatatcatagctagactatgtaacagttacctgtaaattggcaaaagttgtttttggtgtttttcaagatgtattgaagacatttaaaataatttttatagcagtaagggaagaaatagtgatcactgcatcctttctttgtaaaattctatagtatctatactcagtagatgtaatgttaaggttgctaactgcattttgccttatttttgatttcgtggttttttccccccatacatgacgcatgtgaatagcatgtctgagtaaagtaacattttgatttttaggatgaaaatatgaagaatcctagttggtttaagattctttttttgagacggagtttcgctcttgttgcccaggctggagtgcagtggcgcgatcttggctcaccacaacctccacctcccgggtttaagcgattctcctgccgcagcctcccgagtagctgggattacaggcacatgccaccactccctggctaatattgtatttttagtagagacagggtttctccatgttggtcaggctggtctcgaactcctgacctcaggtgatccatctgctttggcctcccaaagtgctgggattacaggcgtgagctactgtgcctgtccaattcttttatcactgttgggataaggacagtgctactccagtacagatttaaccattgcagaattcttaacaaatttggccttgagaatggtgcacaatcaccattagccaattattttctgtgctgtactttttgggctttgttgtatccttaaggcaaaatattaaaaaaaaaaaaaattttcatttttccttattgacttacgacctgtgaaaaaataccagggtttgttcatttctctgtataagggaggctgaaacactttttgtacttaaaagataaccccaaaacaacaaagctgagtgccttcaatatagtaagataagaacattacataaattgttctcttggttagagccatatgggctggcctgtgtgttttaatacaaaagatagtgaactgcttaaatgttcctgggtgtatgtaaataaatgtttttaagaactagcctacttggccttacttatattacgttaacgttcaccaccatttgatgaatgattgatcatgggctttcatttacttttctttttttattttattttatttttatttttagtagagacagggtttcaccatgttggccaggctggtcttgaactcctgacctcaaatgatctacctgccttggcctcccaatgtgctgggattacaggcgtgagccactgtgcccagcctcagttacttattctctatttatgtaatcagaatttttaaagaacggtgaaatgctgatactctgaatgaaatgattgtcaagattacataggttatggccaggcacagtggctcacacatgtaatcccagcactctgagaagccaaggtgggtggatcacttgaggccgggagtttgagaccagcctggccaacatggcaaaaccctgtctctataaaaaattagttgggcctggtggcgcttccctgtagtcccagacactcgggaagctgagtcacgagaattgcttgaaccagggaggcagaggttgcagtgagctgagatcataccagcctgggcaatggagcaagactcttctcaaaaaacaaaaaaaaaacaaaaaaaaaaaacaaaaaaaagactacatagcttatatgcagattaccaatattaaaaaatacataaaacatttaatgataatatttttgttacatacctttaataaaaatatttattttaggcacaattcagattcagaagcgtcaacagttagtcagaaagatacatgaagatgaattgaatgatatgaaggattatctttcccagtgtcaacaggaacaagaatcttttatagattataaggtatgtaccactaacagtatttaaaataattgttagtaattattttgcttattagttagagcttattgtgcttattagtgcagattagtaaatcagtaataatgctgatcattgttgaattgagtacgggtatttagtgtgtcctagtcattgtcatgagtgtaccatatagagtatttctcttattctcacaatatgtgaattaagcaattactaacttttataggtggaaaagaggtttagaaaagttaagtgactttctcaaggtagcaactggcagagctagtttgtttttgtttgtttgtttatttatttgagatggagtctcgctctgttgcccaggctggagtgcagtggtgcaacctcaggttgctgcaacttccacctcctgggttcaagcgattcttgtgcctcagcctcccaagtagctgggattacaggtgtgcacctctatgcccggcaaatttttttgtatttttagtagagacggggtttcactatgttggccacgctggtcttgaactcctgacctccgtctacccacctcagtctcctaaagtgctgggattacaggtgtcagccaccatgctcggccatggcctttttttgttttgttttgttttgtttgggagagctaattaattgattctaaggatttgacttaagaactcttatccctagctgctattttatagttaacatcttttataagtgacattttatatgtgtatatagacatttttattaacattattttcacagagcgaagcaaacattttcagttggcaggagggaaagaggagagttttggttttatagcctctctaagatcttctcttgatcaggggacatagctattcctttccattgtttttttttattctgatggaagggagagcatgttatctttttctgcctataactcacctagatctcgtctcacaggactgtactgtccattctgtcattacctaacacctctgtgggtttatgaggatcagcaaaatagctggtctcttatctagttttttcctaagaaggttgtagagagaaatgcagggtagaaaaataagctatgtctgggtgtggtggcaacctcccaaattcccaaagttggtaaccttgggaagccaaggtaggtggattgcttgagcccaggagttcaagaccagcctggccaatatggtgaaaccttgtctctactaaaaatacaaaaatcagcctggtgtggtggcacatacctgtaatcccagctttttgggaggcttaggcacaagaattgcttcaatctaggaggcagaggttatagtaagctgagatcacactattgcactccggcctgggccacagaggaagactgtctcaaaaaaaaaaaaaaaaaaaaaaaaggaaaaggaaagaaaagtaagctattgttttttccttcatttttccacccccaattctcacacttaatttatgtatgcttcccttacaggttatatttcttgaaaagacaaaaatactactttgtaactaaattgtatctttcagggaggtacttctcccatccaagtactaaccaggccagaccctgcctagcttctgccatcagaggagactggcggcatttagggtgttatggctgtagacacagggaggtacttctgaagttaattataaatagttcagtttttcctacctgtattagaagatgccattttcttcttcaccacagtgttttctggttccataggataacattggcttttggaaaactcaccacgcattaacctctagagagagtttgtagtttggtttgggtttgggttttttttttgttttgtttgttttttttctgagatggagcctcgctctgttgcccaggctggagtgcagtggcatgatctcagctcactggaacctctgcctcctgggttcaagtgattctcctgcctcagtctcccaagtagctgggattacaggctccctccaccatgcccggttcattttttgcattttcagtagagatggggtttcactatgttggccagggtggtcttgaactcctgacctcaggtaatctgcctgcctcggcctcccaaagtgctgggattacaggcgtgagtcactgcgcctggcctgttttttttgtttttgttttttaagagacagggtttcattcttattgcccaggctggagtgcagtggtgtgatcatggctcactgctgccttaacttctgggctcaagcaatcctcctggcttagcctctcaagtagctgcgaccacaagcacacgccaccatgtccaacttggtttttaaatttttcatagagatggggtctcactatgttgcccaggctattctggaacttctgggttcaagtgatcctcccaccttggcctcaaaatactgggattaaaggattgagccactgtgcccagctagagagtcagtttttacagatctcttatttctggctgttaagtgtggatcagatagattttgaagctctttggaagacctggtcaggatctgcttatcaatcacttatgtcaacatcatatttactgcacgaggaatgctgtactcttctttcatcctgtggcttcctgggcttgtgcatttcaagattatgccacaccagtgcatcagtctcttctactccacagtccactgctgttgggtagaagaaatttcttttctctcatacaggtagagcagatgaaatgactgtgattaaattttaaatctttatttgttctctgaagattaatgagccagaacgtgaagcagtcatttcagatagttatttttcaagtgtatattagtgtcattctcttaaaggacttgtatttttttttccttttttttttttcttatttctgaatccaggtaattgactgctctgactcaaatggggtaaccataacgtttgtgataaattaagccaaatttaagtatcattttgcagatttatacataggatatttttaactcgatgtataatgctttaagaacctgttgaaccatattgtttaagttttgactgtttttggttagattttgttactaatgcatatgtgtaaaagaaaattcaaatcagtcaaggatacccttattgaagcagtaaaattctataagccgaattgaccatgatttctaccacgggtgctgactttcagttatagtaatctatagattaatcttcagagttatattaatctgtacagattacagaacttcaaaaatttaccataaaattggataagttagttataaatgttcaagattcagtctgtcttctaacatggttatagaatttatggcttatctgtacttacttagaaatgttaattgcataggactaaaatgtttcaaataggactaagattgttagaatttcatcctttgaagggtacactgagtacaaacaatttttgaagccgtaagtcagctctcgatgtaattttacttttattttttatttgttttttttttgagacagagtctcgctctgtcgccaggctggagtgcagtggtgcgatctcggctcactgcaacattcgcctcccgggttcaagcgattcccctgcctcatcctcccaagtagctgggactacaggtgcatgccaccatgcccagctaatttttgtatttttagtagagatggggtttcaccacgtaggccaggatggtcttgatctcttgatctcgtgatccacccacctcagcctcccaaagtgctgggattacaggcatgagccaccgcgcccagctaataattttaccttttataaaaggtaatctcttttcctgattcagaaaagcctttagtcctgcaagctctagctaactttctgtcttttaaattcttccagccaggcgcggtggttcatgcctataatgccagcactttgggaggctggagagtcgcttgaactcaagaggcagaggttatagtgagccgagattgcgccactgcactctagtctggacgacagagtgagactccatctcaaaaaaaaaaaaattcttacaccatgctgtagttctcaatttgatgtagctctctgctctgcgttttcttgcatatgaaccttgtatttcccaatgtttatactattgaaaatactacccggggggttgtatctgtagaagtaaagacacaaaagcttatggggtattatatcttgaagatttaaattcagcttttaaagcatttgacattttatttcttctctttcaaaaaaaaatgtagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctttatattctgtaacatgaaacttacctaatcttcaaatgttagcttcattttttacctttgaaatacttaatctttctgaataaatataatgtgtctataaaataatgagactgattctggtgtctttagtcattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttaatcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatcttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaggagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaattttagaattgcctattctaattgctgtctacaactttttgcttaataaaagaattaacttataggaagtaaaatactttgatagttacagaactggggctaattttgactggagaaaagactaattatgaaatgtgggttgaaacagaccataaaaaggttatattatctatttacctgagggtttcctaaacctggggtaaaattaaaatactgagttttcctctttttcatgtttacttacctcttccaaaatgctgaaggtgatcaagtgagtaggcaatgatgcatcatcatgaaactctctatgtaaccagtttaagggatttaggtaaaatacatctgcttcatcaagataatgactttttccagtcaggtctggcgggcactggagaaatctcatgggaagtgggcagtgaacatggctatgaaaagaaaagttaccataataaatacaagtaaaacatgaaagttttcattagtcttaagatatgtcatttatacttagcaaaatgtgaaatctgaatctgtaaactgtgttgcagttaagtgaagaagcaagcctttaactcattttctcaaagataaaaaaaacatgattcttataccatgtacctatgcagcagcagcagtataacctataagcccaaactagtgcatagaagtccatttcaaggagggaagtaggtcagtagggggactcaacattctgtagcattggtattctgttccggaaacataaatggtcctcaggaccaggtaagttaacttgttaataggagagtaattctccataggtgtatttgataaagtaggaaactgtgatcataatcagaaaggattctttctctcttccctttctgctctgataggggatggatcacatacttatatggcaagttttttttttttgaagacaagagtttcgctctcgtcacccaggctggagtgcaatggcgcaatctcagctcactgcaacctccacctcccagcaattctcctgtctcagcctcccaagtagctgggattacaggcgcccgccaaccacgcctggctgatttttgtatttttttagtagagatggggtttcaccatgttggccaggctggtcctgaactcctaacctcaggtgatccacccgcctcagccttccaaagtgctgggattacaggtgtgagccaccacgcccagccacatggcaagtttgaagtgttttttttttttatttaagatgattgagaagtagagagcaacatatgtccactgattaacatccaaataagtaatggttttattgtggcatagaaagactagagtaggccgggtgcagtggcttatgcctgtaatcccagaactttgggaggccaaggcatgtggatcactggaggtcaggagttcaagaccagcctggccaacatggtgaaaccctgtatctactaaaagtacaaaaattagccgggcatggtggtatgtgcctgtagttccagctactcaagaggctgaggcaggacaatttcttgaacccagaagacggaggttgcagtgagctgagatcatacgccactgcactccagcctgggcgacagagcaagagtctgtctcaaaacaaaaaaaagattagagtataaaaaagatggattcatttctaataccagttatgacaatttaagccagttacttaggtcatgcaaaaagccatgtttataattgccttaggaaaaattaaacctcactgatacaaacatttaaaatttccagttagaaatggagttagtaattatgcaggaggtttatttatgaaatgcataaaaattaaatgtacacaagacctaatagtgatttatttattggaaatgaaggtcttgtttcaaagggaagcagaaattcctcagaaaaagctgccggcctactctagtctttctatgccacagtaaagccattacttatttggatgttaatcaagggacagatgttgctctctacttccaagtctgatgcaaaataggcatcagactttcctctcttgtgtgctttgaaaaggtgtggagaacttggtgaactattcaaagcctaagacatcaactgactacagttaagtataaagaacatcttggtacatctaggattcctgttctcctcagtattatccctaatgtgagcacggagagtgaatgtccctttttcagccacatatacatatagtagggaatcctcaagttgaaaggatacttgatgtcttccttttagcctgtggtttttgctaggatctccatttttctaaactgtatattaattactggcattaatgattagttaaataggagtattccaagtgttaaattcccctaaaatgataaccactgtaattaaattaattgaacgtgcataggagacattaactccagattgtttaaagccagactgagttaaatagttatagattttatgtatttatttatttatttttaggttgagtctcgctctgtcgcccaggttggagtgcaatggtatgacctcagctcactgcaacctccgcctcccgagtagctaggactacaggcatgcgccacaacacctggccaattttttttgtattttagtagagtcaggggttcaccatgtggcccaggctagtctcaaactcctgagctcaggcagtctgcccgcctcggcctcacaaagtgctaggattacaggcgtgagccacaacgcccagcctggtatataattttctgtaggaaatctggctcctttgcccctataccattactgggtaattagtaactaatacagcttcctgaaataaagcacaggaacaaatggatgtctttttaaaggccatacatagttgaggcaattttagtatatttcccagaaacacttaattcaagcattagaatatcatctagtcgcattccctaattttttacaggtgagacaactgatgtccaaagagattaaaaatctagtttaaggccgggtgcggtggctcacgcctgtaatcccagcgctttggggaggctgaggtgggcggatcacctgaggtcgggagttcgagatcagcctgaccaacatggagaaaccctgtctccaataaaaatacaaaattagccgggcatggtggcacattcctgtaatcttagctactcaggaggctgaggcaggagaatcgcttgaacccgggaggcagaggttgtagtgagccaagatcacgccattgcactccagcctgggcaacaagagcaaaactccatctaaaaaaaaaaaaaaagaagtctagtttaagatgagggcaataatccagtagtaaatctggactaaaatccatgttttttttttttttttttttggagacagagtcttgctctgttgcccaggctggagtgcacctggtgcaatctcggctcactgcaaactccgcctcctgggttcatgccattctcctgcctcagcctcccgagtagctggaactacaggcacctgccaccacgcccggctaattctttgtatttttagtagagacggggtttcacccagcttagccaggatggtctcgatcttctgaccttgtgatccacccgcctcggcctcccaaagtactgggattacaggcgtgagccacggcgcccggcctaaaatccatgttttaagattaattcaaattgtgtaaagatgtatcacagagatttgtagtaaggtaagtaatacatgagtttctttactaagaagactatcagatacctacaaattgttttatactgatttaaatcagaattaggtgtaagtaaattgtttttaaagaataataaagtttacggccgagcacggtggctcacacctgtaatccccgcactttgggaggccagggcaggcagatcacgaggtcaggagatcgagactaccctggctaacacggtgaaaccccatctctactaaaaatagaaaaaattagccgggcatggtggcaggcacctgtggtcccagctactcgggaggctgaggcaggagaatggcgtgaacctgggaggcggagcttgcagtgagccgagatcgcgccactgcactccagcctgggcaatagaacagactccgtctcaaaaaaaaaaaaaaaagaaaaaaagtttatttaaaacattttctttgacacagttcaagtggtttttaaaatccatcagtgaataaatatgtgggagtttaaaatttatcatttgatcagtgaccaattaattcaaatccaggaatctgaaagggaattttaaagtagtcagtttcagtttcttaacagcatatagtggaacatcttttattacctgtaataaggagtagagtggcaaggcatcattataaatattgaagctgaagatttattgggattgttgtaacaaactttttgaatatgactcatgacatcaagagtacctcgttgatgaactaaaccagtataaagggcgaggaacaaatttgataaaaacaggaaacttagagctggtttcttccatgttttcaggtgggttaatgagtatcctatatgaagatagacatattgaaccttaacactgacaatcttttgttatgttaactgcaaatacatctgtaatttttaatggaaatagcaaaaactgtaatactgttatagacaaataagaaataagcaataagtcatatctctgaccattcaccattcactactgtcatctaggtcttgactttttctagtaaaaggtattgaggtatagtggaaagatgatggttatggagtccaacaggtccagatttgaattccagttctagcacaagtcgttttactttgctggtcattgggataatagtaccttattcaagtgttagaaaaaatgtccagtgactgccctggtacatagtagttgctaaataaataggacttttaattattccatttacctacctctttaatctcccaagcactaataattggtattttagtgtgtaatacgagtttcaataatgtgtcctcttaggaaaataagccattgggcacctgggagattttccgtaagtatatgagtggaagaaaaggtgctatgtcttacattttttttcccacaacagtgggaaattttgttttcccactacagtcaggcaatttggagatgctgaacaatttttcttttttgatttatgaaagggattattctgtggggcaaaacaaaacaaaaaaccaaaggaaaaaaccaagtagaatgaatagacgggtataaaaggataagtaaaagtctctctcccctctgatagtccttttcttcagcaacagccactattaatggacatattaggatctactgagaatacaaagaacaggcctttccactggaaaagattaagcttattagtaagcatgacattttgttcataatttacatacactctttttatagaactagataatagttctttttgaacttgggtattcttcatccaaaccttggtttgcccaaaatgttagtacaatactgaatgggaccaaggcagtgttttttattttgttcctcctatgaatatgttaatatcatccacagttcatacctcatgagttggaatatcacatgtccatgtcacctagtattttttaatctacttgaaatagttctgattaaagaataatctgaaaagtggtgtggtgaaaaatgtagcaagattaagaaaactaagcctatcacttaaatctacatttataagatgtttgaaatggtaaaatgaggaacctactaaaaggaatgataattagaactagctttatttgaaataaaatagctgagatgagaggattgcttgaggccaggagttcaagaccagcctgggcaacatagtgagactccatttaaaataaaaaaaaattagccaggcgtgatagtgcgcacctgtagatccagctactgggaaggctgaggcaggaggttcacctgtgctcatgagtttgaggggacagtgagctatgaccacgccactgcactccagcctgggtgacaccctgtctctacgaaaataaaaatgaataaaatagggccaggtgcggtagctcacacctgtaatcccagtactttgggaggacaaggcaggcggatcacttgaggtcaggagttcaagaccagcctggccaacagaggtgaaaccccatctctactaaaatataaaaattagccgggcgtggtgtcagaggttgcagtgagccgagatcacgccactgcactccagcctgggcaacagagtgaaactgtctcaaaataaattaaaaaataggattctaaaagttcaaccatctgtaataaccccaatcacagacacagcagatccccaaatataagttgaagcacttaacttaggttggtaggctaaaacaacatctattttagtaggctcaaatacaaaaagctacattaaagccttgtctttgtttgtactgctatactggaatacctgagactggctaatttatatttacttggctcatggtcctgcaggttgtacaagaagcatccactggtgagggcttcaggctgcttccactcatggcagaaggtgaaggggagtcagtttgtgcagagatcacatggtgagagagcagaagcaagaaagtggaaggtgccaggctcttttgtacagccagcactcgggggaactctcatggaacctaatataaggagaactcacttactactccaggatggtgccaagccattcatgaaggctccacccccatgatcgaagcatctcccattaggccccacctccaacagtggggatcaaatttcaactaaggtttaggggacaaacgtccaaactacagcaagcccatcctacagcaaggcccgagaagatacagtttgttctcaattatttgaagatacttacaaggtgagcatgtgtaaagtgattcacttattaataatttgttcattcaaggccgggggctgtggctcacgcctgtaatcccaggactttgggaggccaaggcgggcagatcgcgaggtgaagagatcgagaccatcctggccaacatcgtgaaaacccatctctactaaaaatacaaaaattagctaggtgtggaggcgcatgcctgtagtcccagctgaggcaggctgaggcaggagaatcacttgaacccggcaggcataggttgcagtgagctgagatcgtgccactgcactccagcctggtgacagagcgagatgtcgtctcaaaaaaaaaaaaaaaaaaaaaaaagaaactatggcactaggaatacaatagtataggtgggtgacacaaaatgggaatacttggtgatcaagactgtgaaaatagcactctgggtagaatgctggaagataacatgcttgtgtttccagcatcttcagtactggtgagacagagcgtctcttaagttaggtaatgcttgccttacatgatggtgattttaactctctgagcttagctcattttaggatggatcattttagtgagaactgaatctccatattacttagagaagtaatataaagaaaatgctgggaagagaaggaacagctgaacaatgccagggagagtcaggtgatagcttagttttcttggggacagtggatactgaaacagttgccattcaaaattgtcttcaacagtattatggatccgatgagcttttgtgtaatattctgggagccttactacatgtcacagtattatttctaagaaaaaaatatttcaggttccaacttaaaaatgaagtttggggataaaaccttatttaaaatagaactgtctttatgattattatttttttgagatggactctcgctctttcgcccaggcgggagtgcaagtggcatgataccggctcactgcaacctccacctcctgggttacaagcgattctcctgccttagcctcctgggtagctgggattacaggtgcctgccgccatgcccggctaatttttgtattttaagtagagatggggtttcaccatgttggccaggctggtctcaaactcaggtgatctgcccgccacagcctcccaaagtgctgggattacaggcgtgagccacagcgcccagccagaactgcctttatttacatgtttagcatcctataagcattactatgcatttgacatataaagaaaatatctttataatttcagttatcatcaaatgacttgtgcacatgttagaaaagaacccaactttagagtataagtcaagagtcctgaatttaaggcctctgaggggtttttaaaccttctggcactgaaagcttccaaaggggatttcagaaatgagttgctaaaggaagggttggaaagattttccagttccaatgctagactgagtgaaccacaagagaagcctaaggtccatggttttcttatagaccagtagtattgtttcatcaatatttaaaacaaatgaacaagattccagtaggtgacatccagtaagtctacttaatggcacgcacaaatttggagatggagttctcactgaaataatccaccctcaaatgacctagcttcagaaagtgatcatccccaccacgtaaatgatgtgtatcccaatcactgaagatttaagactgtgtgtgtaccccagtgactaaagtataggttccttcctttcacatagtaacaacccattgctaactggatgctaaacatcacccctaaatacttaatttgctcctgttatctgggcctacaaaaagatacttgaaagtcggtatacagaaaatttctggaagaactgcttaagaaagtgataacaatagttacctctggggaatgggactagatgacttgaggatgacacactatttttgtaccatcggcatttatttttataataaaaaaatacactgggctcctatcagatcatgttcatcagactactgttacagaaatgtttaaaatccattacatctcagttgactactcttcaggataaaatctaaaaacctgagcatataagaagatacttcatgaggtggttcctttataaagccatatctcttaatcatcatgtattatttagcttgatatacacactttaaaaattttggatatctagcgtggcattctgtattttccagcaatcactaatacgttccttcttaccaaggtaaggttcacggtaatagagaggatgggagtatctgagactgtacattgctgattccatcctggttttgacaagaattatcaggaaacctaatgttaagaaaaaaaatccctaccacattttaccaattagagagatatctgagttactgtttctatttttaaatactctttgagaaagcttagtttcagtgtttagataagaacaacaaaaggtggttcaattctggaatgggacatacagtagaatggggctgggaaagagagactttgaactactaaccataatgagggtactgggcacagatgaaggtatcaagaagaattttttttttttagacagaatctcgctctgtcacccaggctggagtgcagtggtgccgatctcggctcaatgcaacctccacctccagggttcaagtgattctcctgtctcagcctcccaagtagctggcattacaggtgcgtgccaccacacccagctaatttttgtatttttagtagagacagggtttcaccctgttggccaggctggtcttgaactcctgacctcaggtgatccacccacctcagcctcccaaagtgctaggattacaggcgtcagccactggcagctggccaggaagaattttatgttgctattttgttaaggaagtaaagccatctttccatcttcgatagaattcaacagttaatgcctaaaacaaagacctttaagtggcattataaatgttttagagatatcgagataaataccaaaataaccagctgaaagaatgcttaactgattgtttttggggagaggaaatagggagagcaggggaacaatttttttttttaattccttgtggaatgtcttctgaaataatgtacatatgcaattttgataaaaagattagaatatggggccagctgtggtgcctcatgccgtaatcccagcactttgggaggccaaggcaggtggatcatctgaggtcaggagttcgacaccagcctggtcaacatggtcaagccccaactaaaaatacaaaaattagctggctgtggtggcatgggcctgtaattccagctactctggaggctgaggcaggagaatctcttgaacccaggaggcggaggttgtagtgagctgagattgcgccactgcactccagcatgggcgacagagagagactctgtctcaaaaaaaaaaaaaaaaaaaaaaagataagaatatggaaaaacaaagtggcccagtaagagagaagtctatattagccactgtggtaaaaacagataagcagacactcaactcagaatcagtagtgggtgctgaactctgtcagcacaaatgagagattcaaactaagaatttaattagtgttgctaaaatatcacctttcttttacagataaggaaaatgaggcacattgttgaacaattcactaaagatcagagccagtcacaaaatatattttctagagttgagtcctattttataggactaagggaaattcaaattaggcaagagaagttaccgtagactgaaaaaactgctgcaattatttttcttcctgtgtcccatcccactatgaggttggcatttatttccccacctcttgaatctggcctggcccagtgacttgctttcatgaaaagaatgtggtggaagtgacagtatgcaaattccaagcccttgtctcaaagggccttgcatatttgctccctctcttggaacccggcctatgccaagtgaacaagccctagctggcctgttggaggaagagaaaactcagaagagctgagaagacttggcctacagctagttgaaccccagacatgagagcccagcctaggtcaatagagctatctacccaatctgcagctgtgtaagtgagctcagtggagatgagaactgcccagttgaaatgtagacctgtaaattataataaatggagttttaagccactacagttttgaggtggccttttacacagcaatggctgacagagttgtcatgtttacataaaaataggttaaaacaagtcacacaaagcagaataaggctgaaatttgtggtataactcaagatttcaagtagttaggaaagattcaaactgggtcactaaaacatcaagagctccaaagagaactgttctaaatgtccagagatttctgtctaggtgacatcactagacagaactgatcctactgttggaacctcttggcattaaacagccctgactgttagtggaagtacaaatctcctaggaattagagttttttgacccactctagaaccttaggtagggtgtggaggaaaagaatgcatcctgtgaggagatcaaggggttttctaggttgctgtcttttagggatccttctaagtagacagaggatggaagaaggggtgattcttacctattagaaggggctctctttacccctcatcagcattttatctcaataaactgtgaataggccctggttacagggatcttgccacttaaagattcaatcttttagactggcaatgaggattcagacaactcaatctttgtgtaaatacttggtaaagcaacaggacacagaagaggaatgctggaaaaatctggtttatgaaaacagaaatcaaaccaagttactaaccaacctccccgtcccctccaggcacacaaaaacatttgcctttgtactctgccaatgcttgatttaattataatacacactcaagtggctgtaaaaaaacccaacagaacagaaaccatttaacatctgaatagtgatttatgaacagatttcctctgacaaatggggccagctattcttaaggcttgccaaatagctgttagatgtctaaatttttgtatgtgcctgcgtttgtatgtggttacactgtaaagtaatgacagactgaggctttgatttcagaacttcagatgtatcaaaaatacagatttttaatatttgattttatatttgtatgtttatcttcttaaattgaagagattatacatctcagatctgtaggagttgatgtatacttggtcaaacattgcctaactcaatgtttttctttttttttaagtaaaaaataagtttgaaaactgtaactccctaggttttttccagcctccagttccagttggctagtcatttcttctctctcaacgctgtgattttttttaaggtcttaatatttgaaggaagtcaacagtcatttattccgaattaaacttgaagttaataaagtttcaattcgtaatttttccaaaccaaccaatgtaaaaacccagattttcctgaattgagtcatgtaaggatttttgtaagtgacaaaaaaatacatgttaagactgtggaaaaatggagaaaaggcctgaataaaatcaggagttaattacttaaaaaatggcatatgccaggctgggcgcggtggctcacgcctgcaatcccagcacttttgggaggctgaggcgggtggatcacctgaggtcaggagttcgagaccagcctggccaacacggtgaaaccctgtctctacttaaaatacaaaaattagccgggtatggtggcggatgcctgtaatcccagctactcgggaggctgaggcaggagaattgcttgaacacagggaggtggaggttgcagtgagccaagatcgtgccactgcactccagcctgggcagcagagtgagactctgtctaaaaagataataataataattgcatatgccttagagtgagttttaaaagtgtaaatgttttgtgtgtaaaagcattaaaaactagtttcaacagcagtaaatacatttttcctttgtgaaaatgaagacccttacagtttaaccataaacttaaaatagctaatctaaaaacagacatgttactttactttttagtgagaaacaccaccaccaaatagaaacaccaccaccaaaaactgctttgggtattggatatttatgtgggttttttgtttgtctgttttttgagagaaggacttgccatatggtaggctggtctcaaactcctgggctcaggtgatcctcctgcctcaggcttctgagtagctgggattaaaagtgcacaccactgcactgggctaggatctttatgtttttatctcactttagaggatataggaaaaaagatatttggactacaaaaagggaatattgcagtaatataattaatctgtaattaagtaattccttattaacctagttgaaaatagacatagtttaatgaggatgtgttgtctttagactatttctatataatttattttctataacaaacaaaagcacttaccacagaacaccatacagaatggtaaaactggataaataaacctgaattctttgtggctcaacatgctgtaataaaaacaaatattattaaaaaatattaattatcatgttatatgatagattgagaaagtaatatatttaatataaaatatatttaacttgatctatttattttctaagtattcagactgaatttcttgcttcagaaattcatcttattttttagttataaggtgattatgatatggtaaaactaatcataaaatatgatgtcaatttgaaattacaaagtacagttacattctaaaaacgggatttctatttcaatccaagtaagtgaaattagtcaaatttggaataaggatacatacatttttattttagaatgtatttctgtggtccttcaatttaaaattttggtagtattgattgactgattgactgagacagggtcttgttttgtcacccagactggagtgcagtagcacaatcatagctcactgcaaccttaaattcctgggctcaagcagtccttctgcctcagcttccccaatagctaggactacaggcacatgccatcatgccctggtaattttaaattttttttcagagagagggtcttgctatgttgctcaggctggtcatgaactccttgcttcaagcaatcctcccaccttggccttcaaagtattgaaattacaggcatgagcaactgtgcctggtctgttttttttttttttaaagcaaataaaattagtccaagttcttaaaaattgagtgtaatccttattaagcaaactacatatctaaagtattcactctagtgcctccataattactactacttgtatcttctaagataattcccactaacaaaagttaatggcacctccaaaacataaagtttactttttgaagaatttaatttgatttcttggtaacataaaaaattttagccttttgaacaaataaaatcttacctataaacaagcagtgtccacagcacagtcaccaaaagtatccggtatctctttggtgctagatagcagccatgaataaagaagggtaagtgagtacccaagataactggaaatccttgactgaagtaccagtgccatggatgagaaccataaaatgttccccagttctgcagcacgttaaatttcaaaaaattaaattgaaccagagtccactggcaccgttgaaggaaaaataaatagaaatgtgttagtgccaagtagtaatctttggcattaggggattgatacaattttgacattaaatcagaattgaagtctaaaaaccaggcaatagtttacattaataatttttttttttttttttttttaagatggagtcttgctctgtcgcccaggctggagtgcagtggcgcgatctcggctcactgcaagctccgcctcgcgggttcacgccattctcctgcctcagcctcccgagtagctgggactacaggcgcccgctaccacgcccggctaattttttctatttttagtagagacggggtttcaccatgttagccaggatggtctcaatctcctgacctcgtgatctgcctgcctcggcctcccaaagtgctgcgattataggtgtgagccaccatgcctggcctaataattttaattaatgactgtatgaaatccttcttaactgttattttttcttctttaagtattaatgtgttccttgttaatttgtaaaactagatttttgagattcaaagtgagaatcaaacttatattttggcagtctaa

SEQ ID NO: 841 - DNA, 109361 bp, Homo sapiens
gtagtccggccgccctgtgactaacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggtaaaagccaagaggctctcataggcgccttggcagagttgccattggaacgggcgtcctctagtagctgggatctccccgccccttcctcctgaggggccactcctttctgccccacccttcttattgccccaccctttgccacactccttcagagatgcgcagtgctgcccctttctatgggcagggccgaaggtccgcgtgtaaaagtacccagtccctggtaacctgacacttcccttttaaaagccaccttttgtctatctctggcctgccacgattcttcctgtgctccataggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaaggtaagaaattaaaccttgaaaactaaactgaaaagtcatctgtgtttgacaagtcagactttctccaagaagaaaactaaggagtgcatattttccattattataaatagtgaaaatgagaaatcatagcaactccctggaaaatcttgctctgccagttttctaaatcacagtagggcctcgatatggttttatttgtttttgtttttgttttggagtgtgttcaccttttgaatataagaatttgcggttttgaccaagtttttaaattttcagctattgtttatttgtttttgtattatatttaatttttctgtctctccctctctgtctcagactcaatcatttcacaggtctcttaggcctcttttcattttctttaaacttgtttcagtcttcagattggatggtttatattgctgtcttctgtttctactctgtaaactaaaagttctttttattttattattttattgtcttctattttactctttttataatttccatgtctctgctgagactctacatgagttaattcattatgagaatattttcctttacccccatgaacgtacttataatagctgccctgaaatacttgtctgctgattacatcatctcggacatcttagaaatagcttctgctgcctgctttttatcttgtgtatagtttgcatgttacatttcttcacacattttatgaattttaatattgtgtaatagaaattataaatattagttatagagactaaattctgttgtattctttggaagagcattgttattatttgaagagggggtaaatgtggctgaattcaaacagaataattatcttccctacggtgggaaaggttgaaattctcattcagtcacacacacgtatgtatgtattgtatatagatgaatgtttctatgtaactatatataatattttatccagattgtatcattgttatctgtgagagtgttagtttagcaagctactccagtattaccggaagccagaacttcagttttgttttcttactggattttatgtaaatgagagtatctactatggatagttttacacctactttttctttttttcttttttagttatttgagacagagtctcgctctgtcaccaggctgtacagtgccgtggcctgtctcggctcactgcaacctccacctcctgggttcaagcgattcttatgcctcagcctcccaagtatctgggactacaggcatgcgccaccacgcccagctgatttttgtatttttagtagagacggggtttcaccatgttgaccaggatggtctcaatctcttgacctcgttatccggctgcctcctcctcccaaagtgctgggattacaggcgtgagccaccatgcctggccacatctacttttttaaatgtgtcattatatttgtgatattgtcatgatgttttctacttatattttattcaaaaattttatactttaagttcttacctttaggtctttgatgcatttttatttgtttatggtgtagggtaaatgttcaacttcatccttttgcttgtggatatccattttttcccagcaccaattgttataaagacagtcctttgcccattgaacggtctttgtatccccatcaaaaattatttgaccatatgctgctttatactgttccagtgtccatatgtgtgtctctttgccagtaccacactattttggaactttgtattaagctttggaatgaataagtgtacattttgtaacactggacttctttttcaagataattttgactcattggggtcccttgagattccatatgaaatttaggtaggatttttctatttctgcaaaatagaattttttgctttttttgttactcccgacgtattttattcttttcagtgctattgtaaatgtgcttgtttgcttagttttgttttctaattattcatcattactgtatagaaacacaagtgatatttgcatgttaattttgtatgctgctactatgctgaatttattagttgtaatactttttgtgtggatctgtgaaatctctagagctttccacataaaattatattatctgtaggctagagtaattttacctctacatttccaatttggatagtttgtttctttttaattcttaatttgactagaacttccaacactatgtggaatagaaatagcaaaagcagacacctttgccttgttcctgagcttagagcagaagctttttgtctttcaccctggagtacattgtttgatgtggttttttaatgtgtggatttcacaatggtagtattttagttttaaaattcctacttttttgagtgttttcaccctgaaaagattttgaatttcataaaatacttttctctgcatccatgaggtgatcaatgtttcttttattttgttaatgtgtacacattgatcaatttttatatgttaaaaaattcatgttttaagatatccttgcattctaagaataaattgcacttggtcgtggtgagatcatctttctttttttttaaattttattattattatactttaagttatagggtacatgtgcacaatgtgcaggttagttacatatgtatacatgtgccatgctggtgtgctgcacccattaaattgtcatttagcattaggtatatctcctaaagctatccctccccgctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttggacatttgggttgcttccaagtctttgctattgtgaatagtgccgcaataaacatacgtgtgcatgtgtctttatagcagcattatttatagtccttagggtatacacccagtaatgggatggctgggtcaaatggtatttctagttctagatcccggaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttctcccactttttgatggggttgtttgtttttttcttgtaaatttgtttgagttcattgtagattctggatattagccctctgtcagatgagtaggttgcaaaaattttctcctattttgtaggttgcctgttcactctgatgtagtttcttttgctatgcagaagcgctttagtttaattagatcctatttgtcaattttggcttttgttgccattgcttttggtgttttagacatgaagtccttgcccatgcctatgtcctgaatggtaatgcctaggttttcttctagggtttttatagttttaggtctagcagagccctcagaaataacaccacatatctacaattatctgatctttgataaacctgagaaaaacaagcaatggggaaaggattccctatttaataaatggtgctgggaaaactggctagccatacgtagaaagctgaaactcgatcccttccttacaccttatacaaaaattaattcaagatggtgagatcatctttctaatatgctgctgaattttatttgctggaattttgttgagttttgcatctgtgttcataagggataattaatctgtagttttctgtagtgtctttttctggctttgatatacggtaatgctgagattgtggaatgagtttggaactgatctctccttttcaattttttggaagagtttgaaaaagattttcagtctttcaaaatgtttggtagaattaactactgaagccatcaggtcaagggcttttctttgtcagcaggtttttgatttttgatttgatttccttataagttatggatcaattcaatttttctattcttggtaatcaagtcttgctaggttttttatacctagaaatttgtccatttcatctagattgttcattttgttgtcacacagttgttcacagtacactctttaaaacattttatttcttagaatcaggcaggcagatcatgagatcaggaaattgagaccattctggccaatatggtgaaaccctgtctctactaaaaatacaaaaatcagctgggcatggtggtgcatgcttctaatcccagctacttgagaggctgaggcaggagaatcgcttgaacctgggaggcggaggttgcagtgagctgagatcgggccactgcactccggcctggtgacagagcgagactctgtcaaaaaaaaaaaaaaaaaaagaagaattagtagtaatgtccccatctcatttctcattctactattttgagtattctgtaatttttttcatagtgtagctagaagtttgtgaatttgtcaacatttttgaagaaccaagaaccaacttttggttttgttggttttctgtttttctggtctctattttctttatctctactaagatcttcattattttcttctttctgtttatttcgtgcatagttcattctttttctaatttgttaggtcataaagttaggttattgatttgagacccttcgtcttcttcttcttcttcttcttctttttgttttgtttttttgacagagtctcactctgttgccgaggctgtagtgaagtggtgcaatctcagctcactgcaacctccacccgctgagttcaagcgattctcctgcctcagcctcctgagtagcttggattacagatgcccgctaccatgcccggctaatttttgtatttttagtagagacaaggtttcaccattttggctaggctagtttcaaactcctgacctcaggtgatccacctgcctggcctcccaaagtgctgggattacaggcatgagccaccacgcccagccaaggcccttctttaatgtgtttatagctataaatttctgatcttcacactgcttttgtgcatctcataacttttggtatgttgtattttcattttccattctctgtattttttaatttcccttgagtttttttcttttacttattggttgtttaagagtatgttaaattttacaactttgtgagtgttttagttttccttctgttattgacttgatttgtgacataacatacagtccatcctggagaatgtccatgtgtgatccatggacattgagaatagtgtgtattcttctgttgttgggtggagtatcctgtatatgtatctgttaaatttagttggtttgttgtattatataagccatttatttctaacttatcttctatctggtgattctgttcattacagagagtggagtattatcatctctattattttagaactgtcgacttctccaattctgtcgacttctctcttcaattctgtcgatttgtgcttcatatattttagtggtttattattaggtacatgcatgcttataatatttatatcttcttgctaaagggacttttgtgaatacacagtgtctttgtatttttatgtaagatttttgattttaagtctattttgtctgatattaatatagccaacccaaatctattttgcttactgtttgcacgaaatatctgttttcttccttttactttcagcctagttgtatctttgaatctaatgtgaatcttgtaaaaacaagatagttagatcatgttttatagtctgttctgctgatttctgccttttaattggatagtttaatacatttacatttaaaataattacttaaaagtagagagttctgtccttttgctatttgttttctgtatatcttacatcttctagttttgtattttctacattatttcttcttgtttggttgattttttctggtgaaacatttacactttttattttcttttgtgtatattctatggcttttttgtgattacgatcatggggatgacatttaacacctgagtttatttattttaattgctgcataggactatattcagtcacatatttgtaactagtataatttttaaatccagtctacttttgatagtaatcattgggatattttttatactttatttttttggtaagtatcaagtttacataaatattaagtggaaagcacagagtttccatgtatcctctccctgcacccagcttctcctctgttattaacaccttactttggtgtggcatatttttactgttaatgaactaatatagaaaagttattattagctgaaatctaaagtttgcattcaaattcatggttttttttattttaaaatctatggattttgacaaatgcataatgacatgacatgtatccaccattactgcattatgcagaatagttttgctgtcttaaaatatatgctgtaccccacctattcatctctcccttcttccccccaaacttggggataccacagatcttcttactgtctccttggttttgccttttacagaatgtcatatacttggaatcatatagcatgtagccttttcagatttccttctttcccaaccatatgcacttaaggttcctcatatcttttcaaggcttgacagctcatttctttttatcagtgaataatgttcgttgtatagttgcaccccagttagtttattcatttacctattgaagaatatcttggttggtttcatgttttggcaattatgtataaaactcttcttaatagtagggtgaagagttttgtgtagatgaaagtttccacctcttttggataaaggccacagagtgtgattgctggattgcacttaaatgtatgtgtagctctgtaagaaaccggcaaactgtcttccaaactggtcatagcactttgcatattcacccgcgataaatgagagtgcttgttactctatatcctcaccagcatttagtgtagtcattgttttggattttagccattctaatatgtgtgtggcagtatgccattgttattttcaatttcctaatgacatatgatgttgagcatattttcatatgcttatttgccatgcttatatgttctttagtaaggtatctggatcttttgcaattttataattgggttgttcatttcttattcttgcgttttaagagttctttatttcttgtcgcatattctggataccagtcttttatcagttatgtgttttgcaaatattttcttttattctgtggtttgcatttttattcttttaacagcatctttggcagtgcagaaatgttatttttaaaatagttcaacttagcagattttcctttcatggataatattttgggtgttgtagaaaggagcaaaacctgaggtaattcagattctgatctttgttattttctaaaagttttgtgggttttccttttatattgagctatgatccattttgagtaatttctgtgaaagttgttaggtctgggtttaggattttttttttcttttctcttgcatgtggatgtctagtttttccagtactgttttttgaaaaattattctctctcaattgaattgcctttgccatttcatcaaaaataagctgactatatttgtgtgggtcaatttccgacctttctcttttgtatcgtttatctgtttctctattatttttaacagtaccatgttattttgattactgtagctttatagtagttcttacagttgggtagtgtcattccaactgttctttttgaatattttctgggctattctgggtcttttgccttttcatataaactttagggtcagtttgtcaatatccacaaactaactttgtggaattttgattgggactgcattgaacatgtaaagttgggaggtactgacattttaacaaagttgaatgtttcttgaatgtgaattttctctctatttatttagatcttctttgatgtttttattcacagttttgaagtgaataaagtcctatatttatatttattttgttagatttgcacttaagtattttattgttattggtactagcataaatatcattgttttaaatttcagattctaattacactgctaatatgtaggacaataattgacatttacattttcttataatttgcaaagttggtataattgctcattataattggttattctaagattttgttttgtgatcctttcagatttctccataggcaattatatcatctgtgtaaaaagacagttttatttcttccttcctaatctatgtaccttttctattcttgtcattgtattacctggggcttacagtataatgttgtataggaatggtgagaggagacatctttgccttgctcctgatcttagcaggaaggcatctagtgtttctacatttagtatgaggtaagatgtaggttttttttaataaacattcttttgaaattgaggaagtttttccctatttttagtttgcagagtggttttctcatgaatagattttgaattttgtcaaataatttttctgattatattgataagatcatattatctttttatatctcttaatatgatgaactaatttctttaaaagacagagtcttgctatgttgtctgcgcttatcttgaactcctggccttaagtgatcctctttccttggcctcctactgcactgggattaccggtatgagccaccacacccagcctaatttatattcaaatgttgaaccagatttgcatgcctgtaataaatctcactgggttgtagtgtataattctttttatacatttttggatttgatttcttaatatttgggtgaggatttttgcatctttgttcacagagtaatagaatagaattataataagcactctgatagaaatcagtttcgttcctgcaactatccctagaaaaatacaatagttggcagaaaaggaaaaaaatagatggaataaattataaattaagtggagaagagaaaaataatctgcagaagtaaattgtcaaccagtttgaaatcaggtaaaatgtagattcatgatttctactctttctgaataattgtacaattctgtgcaataggagcttctgtcagtgcaaatatggagtcacctatggaagagctttgctcaaaccagccccctgacagccagtccctcaggcccagaagtcatgaatcgttcctccaataagtcattcagttggctggcagcaaacactgttaagattctggatggcagctgcatttcatattagattttaacagaaactcatgatgaaaagtctttaagacctaaacgtccaagtatattattgtataattttgagtattagaaaatcagtaggatgttctttcagcatttctgaaataacagtgcaaaaatagctccagcttcataaggccaacctttggtatctgtgttctgcaaaatagggtaagcaagatgccacaaaagccaggttgtatgtgtaattatcttcgctacaacaacaggactatcacactttaagcaaccctgtgggtctttaaaataaaaaaaaatgtaagacgtaaagaaaaactttcttgagagagaacattttacaaatcagaggaaaatcttgcagaacttttacattttataacaaataaattatatgctctattgttttcctctgagtacatcatcagtacttccataatacttttaatgtttaacttgagaaaaccagtagcttaaaaaaacacaaaggcacagtaaaaatcctagatatgtagaattaatatacatatatttttagatggagtctcgctctgtcgccaggctgcaatgcagtggcgctctctcggctcactgcaccctctgcctcccaggatcaagtgattctcctgcctcagcctcccaagtagctgggactacaggcgcatgccaccacacccagctaattttgtatttttagtagagacagggtttcaccatgttggctaggaaggtctcaattttgacctcatgatccgcccacctcagcctcccaaagtgctgggattacaggcatgagccactgtacccaaccagaattaattttcataagctgataaagaaataacacaccagtgtcttctcagggaaaagcttttaagcaaagcaatcatttctggtagggattatagaagagggagttatcatgatgaaatggtggaactaatccaggacattccagattttgattattgacaaaagaatttaatcagttgcccaggaatactacttggaaatccaacttgaattattattcttagaaacatttctgaaactttccctttggaaacaagtttttatcttaagatataccagacaatagaagaaaaaaatgaaacagcaggcagaggaagatgaatcttgcttaggcagggactgagaggaaattagtgcccgtggaccacatctctgagtccactgtgtgacagctttctccaggaccacatgtgctccactgaacaagaagagtccaccttcaccttattccctgccaatgtcaaaattaaaatgaaacagcctaatatgagaatcagagtatataacaaaacttccgttacatttaaagcatgcaaagtatttaattgtaaattcaaacagtggaaaaacaaatttgcttgcctcctgactaaaacattattcttttatgagaacatagtctgtgattgctaatctcatcaccagggataaccagtttagcatggcatagaaccacctctgtgcagaggtaaatatgcatttatttttataaaacaaagattatactctgtacttttataccacacttttaaaatacctgttgttattgtgatcattttataattatttgaaagaacctcaatggctatacattaaatcaaaataacatttcataatttcacaattttcctactggacactgagtttgctttcatggaagttcatatttgtatgataatttgagggaagtttctctgcctcactagattaaaaactttgtgtttaatgtttgttcactgttgtactcttatttcataggagtacctgaaacatatcaggtagactgcagcatctgttgaatgaaggaatctctccttcaaatcttggctaaaatcagccttatctacaaaagtttctgaccctcactttaattataaacctctttctcttctataatttgcttctctagctgttttttgggactccctggcagggaaaatacatatagcaatgctttctacactatttaaaaccaccagagatcaggcacactacccctgatgaggcttgtgccactagaaaggaaaggcaggtttgtgagattgatctctctcaaaatatttgttttcaatccccatattatcaaatatgcacccaaagtggaaacgaggactggaaagaataaatacatcaaaaatataaccagaccgtgcatggcaggtcatgcctgtaatcgcagcagtttgggaggacaaggctggagaattgctgcccaggagatgtgagacaacacctctaataataattattattataattaaagttaaaaaagaaacatctctcctcaaaagataagtagatagataggtatatagataggagccaggcacagtggctcacgcctgtaatagcagcagtttgggtagtcgaggcaggaggattgcttgagtgcaggagttcgagatcaggctgggcaacatggcagaacccagaaccctgtctgtacatacatacacataaaaaataaaaataaaataaacataacaataacaaagaaacaataacaaacaataatagaacaataaacaaccaaataagtgggaatgaactaaggtaaataggcaattaagatcataattgttgtctctctctctctctctgtccctttctctctctctctctctctcgatctttgtgtgtcacactgtcacacccaggctgtagtgcagatgtgcaatcatggctcactgctgatcgcacaagctgcactccaaccagggtgtgacagagtgagaagacctagccctcaccccccaacaaaaaaatctaaaacattaacttcagtgtgcaggaaggagtgtaaaaaacttaaaacagagagagagagcaaagaacaaaggaaaaaagcagcaaccccctctaagtattgtggaagcaaactgaaaattgtccgagtagtcccagctactcggaaggctgagatgggaagaccacccaggcaagaccagggagatcgaggccacagtgaatcacgatcacatgtctctgttggacctgagcagtactgccggtggtgagaaccgtctggtcgaccttagatgtagcaagctagcagctaggtccagtacccacagccgacacctgtctcaaaataaataaacaaaaaaacacaacagtaaatatttaacaataacaaagaaataataacaaacaataataagaccaataaataagtgggagtgaacaaaggtaaaagataattatcacaattaaaatcttctctctttctctcacactctggctggagtgtgacaaaaagaaaaaatctgaaaggtaaacttcagcatgcaaaaaggagcataggaaaatagagaagaacgtaaaacctaaaacaatagcaagtcactctaagtactgtggaaacaaactgaaagttggattagaagagaaaaaaaaagaggaagttgagaccagcctgggcaacatggcagaacctctaaccctgtctttacacatacttccccatcaaacatttaaaaatacaaaaattagcctggtgtagtgggacatgcctgtagtcctagctgctcaggaggctgaggcagaagaaccacttgaacccattaggcagaggttgtggtgagccaagatcacaccattgctcactctagcctggccgatggagcaagactctgtctcaagacatgaaaataataataataaaaaaagtagaagtaaaaaatacaaaagtcaactggtgtggtggcttgtgtctgtagtctcaggtactggggaaaggggaggcattggaggcgtgaggattactcaagtccaaagggttgaggctgcagtcattctgggtgacagagtgagaccctttctccaaacaaacaaacaacataacaataacaaaaatataataaacaataatagaacaataaacagccaaataagtgggagtaaacaaagttaaaggtaattaatatcacacttaagatctctctctctatatatatttgtcaaacccagtatgtaatgtgtcaaaaaaactctaaaaggttagcttcatcgcgcaggaaggggcgtaggaaaatagagtaaagaacaaaggaggaaaacaacagcaagtcactgtaagtactgtgaaaataaactgaaagtagggctagaaaaaaaacagagaatgtccgagtagtctgatggaattgggagtctgagatgagaaggccacccaggtgagaccagggagattgaggtcacaatgaatcacgattgcatctctctgctggaccttaatggtactgtaatggacaagagccatgtagctcttagatgtggcaaagtgagagccttctgttcgtccttagacttggcaagctgctggctaagtccagtgcttatggccgatattcgtctcaaaataaataaacaaaaaatacaagagtgaattcttaacaataacaaagaaataataacaatatgaaagatcaataaataagtgggaatgaaggtaaaaggtaataccacaattaagaccttctctctctctctttctttctctctatttgtcacacctaggcttgagtgtgattaaaaaaaaaaaattaaaaggtaaacttcaccgtgcaggaagaagcataggaaaagagagagagaaaagaacaaagaaaaaaaagaatagcaagtctctccaagtactatggaaacaaacagaaagtggaattaggaaaaaagagaggaagaaggtctgagtagtccaagggacacgggaggccagttgggaagaccgcccgggcgagaccaggaagatcaaggccacagtgaatcacgatcccatccctctgctcaacctgaattgtactgctgctggcgagagagatctggtcgaccttagacatggcaaggcgagaggtgaggtccatcaggtcgaccttagtccaacgctcacagccgacatctctctcaaaataaataaacaaatccaacagtaaatatttaacaatgacaaaaaaattaaagaacaatacataaacaggttgcagttaacaaaagtaaaaagtaattaatatcacaattaagatcttctcccctgtctctctgtttgtcacacccaggctggagtgtgtgacaaaataaaaaatctaaaagatcaactttattgtgcaggaaggaatgtaggaaaatagagaaaagaacaaagaagaaaaacaaaagcaaatcactctaagtactgttactgtggaaacaaactaaaagtgggttaaaaaaaaaaaaaaacagaggctgggcgtggtggctcatgcctgtaatcccagcactttgggaggtcaaggcaggcagatcacgaggtcaagaaatcaaggccatcctggccaacatggtgaaatcccgtctctactaaaaatacaaaaattagctgggcttggtggcgtatgcctgtagtcctagctactcaggaggctgaggaaggagaatcatttaaacccaggaggtggaggttgcagtgagccaatatcagccactgcactccagcctggcaacagagtgagactccatcaagatcaacaacaacaagaacagcaaaaaacagatgaagaaggtctgagtagtctcaggtacacggggggccccccaagatgggaagaccacccgggtaaaacctgggagtctgagttctcagtgaatcgggaatgcatccctctgctggacctgaatggtactgtcaccagcaagaggcatctggtcaaccttagacgtggcaagctgatggctaagtccaacacttgcagccgaaattggtctcaaaataaatagacaaaaaatccgatggtaaatattgaacaataacgaaaaataataacaatattaaggaccaataaataaataagtgggagtgaacaaaggtaaaagataattatcacaatgaagattatcacaatgaagattttctcctctctctctctttctcaatttgtcatgccaggctagagtgtgacagaaatctaaaagatcaacttcatcgtgcaggaaggagcatagaaaaatagagaaaagaagaaaacagcaaaccattctgagtaccgtggaaacaaactaaaagtgggcttagaaggaaaacagaggaagaaggtctgagtagtcccagggactccagaggccaagatgggaaagccacccaggcgagacaggggagatggaagccacagggaatcactatcacatacctctgctggacctgaatggtcctggcgccagctagagccatctggtcgaccttagacatgtcaaggcaggagccatctgatcgaccttagacttggcaagctggtggctaagtccagtgctcactgccgacatctgtctcaaaataaacaaaaagtccaacagtgaatatttaacaataacaaaaatataataccaaacaatattaaagaccaataaataagtgggagtgaacaaaggtaaaaggtaactaatatcacaattaaaatattctgctatctctcactctctctcttcccctttccatttgtcacacccaggctggaatgtgacaaaaaaatataaaaggtcaatttcatcatgcaggaatgagtgtagaaaaagggagaaaagaacaaagaagaaaaacaacagcaagtctctctaaaacttcagttagtttcactgtagaaaaaaaaattgaaagtggggttaggaaaaaaaggaaggaggaggataagttcaggtagcctgagggactagggaagccaagtgggaagaccacctgggtgacactgggaagatcgagaccacagtgaatcatgatcacatccctctgctgtacctgaatagtacttccaaaggcaggagccatctggtcatccttagtcatggcaaggcgagagccatctggttgaccttagataaggtgagagccatctggttgaccttagacttggcaagctggcagctaagtccaatcctctcagctgacatcttggagagagagacagacagacagacacaaacagcgagacaggagaaaatcttaattgtgttattaattacttttcacctttgttcactccaaacagaaaaaaatccaacagtgaatatttaacaataacaaagatataactacaaacaatattaaagacaaataaatgggagtgaacaaaggtaacaggtaattaatatcacaattaaattcttctaatctctttctatctctcactctcgatttctctctgtcaacttcatcaagcaggaaggagcacaggaaaatataaagagaaaacaagaaaaaaatagaaagtcactctaaggactgtggaaacaaactgaaagtaaggttaggaaaaacaaaggaaggatgtcgaaatagtctgagggaatcaggaggccgagatcatcagaaggccaccctgtagagacctggaagacgcccagggcacagtgaatcacgatccgatccctctgctggacctgaatggtactgctgctgctgagagccatcctctcgaccctagacttaccaagctggtggctaaatacaaccctcgtgggaagatctgtctcaaaagaaaaaaatccaacagggaatatttaacagtaacaaagaactaaccataacaatattaaagacaaataaataagtgggagtgaacaaaggtgaaaggtcaattatatcacaattaagatcttctctctctttctccatttgtcacaaccaggctggattgttccaaaaaaaaaaaatctagaaggtcaaattcatcatgcaggaaggagggtaagaatatatatagagagaaaagaacagagaagaaatacaacagcaactcactgtaagtactgtagaaacaaactgaaagttgggttagaaaaaaaaaaagaagaaggtccaagtagtctgaaggactcgggaggccaagatgggaagtccacccagatgacaccggggagatcgaggctgcagagaataaggatcacatccctctgctggacctgaatggtactgatgctgttgagagccatctggtcctcagacatgggaaggcaagagccatctgttcgaccttagacatggcaagatgaaagctaagtccagtgctcgctgccaacacgtttctcaaaataaataaacaaaaatttcaacagtaaatattcaacaataacaaagaaataataacaactttaaagaccaataagtaaataagtgaaagtgaacaaaggtaataggtgattaatatcacaattaagatcttctatctctctacttctctgttactctctagctgtctctgtttgtcaaacccatgctagagtgtgattaaaagaaatataaaagtcaactgcttcctgcaggaaggagcatagggacataacgagagaaaagaacaaaggaaaaaaaaaaaaaacagcaagtcactctatgtatgtggaaacaaactgaaagtggggttagagaaaaaaaagaaggtccgagtagtctgagggactcaagtggctgagatgggaacaccagccgggtgagactggagagatcaaggttacagtgaatcacaattacctccctctgctggacctgaacggtattaccggaggcaagagccatctggtcgaccttagacatggcaaggcaaaagtcctctggttgaccttggtccaatgctcgtggctgacatctctctcaaaataagtaagcagaaaatccaccagtgaatatttaacaataaaaaaagataacattgtgtcaataaataggagtgaacaaaggtgaaaagtaatcgataacacaattaagatgttctcctctctctctctctctctgtttgtaacacccagactggagtgggttcatatttatcatgctggaaggagtgtagaaaaatagaggaatgaagaaggaaaacaacgcaagtcattctatgtactgtggaaacaaactgacagtgggtttagaaaaaaacaacagaggaagaaggtctgagtagtcccaggtaattgggaaaccgagaagggaagaccactcgggtgagaccagggagatcgaagccacagtaaatcacgatcacatccctctgctggacctgaacggtactgccgcctgcaagagccatctggtcgaccttagacatgacaaggcgagaaccatctggtcaaccttagacatggcactcttgtggctaagtccaactctagttgctgaaatacgtctcaaaaaaacaaaaacaatccaacagtaaatgttttacaaaaacaaaaaaataaacaatattaaagaacaatgtataaataagtgggagtgaaccaaggtaaaaggtaattaatatcaccattaagatctcctctctttctctttttctctccatttgtgatacccaggctggagtgtgacaaaggaaaatctaaaaggtcaacttcatttacaggaaagagcataggaaaacagacaaaagaacaaagaagaaaaacaatagcaagtcactctaagtactgtggaaataaactaaatgtcaggttaggaatagaacagtgaaagaaggtcccagtagtcccaaggactcgggaggctgagacacgaagactgcccaggtgagactacagagactgaagttgcagtgaatcatcacatcctgctactggacttgaacagtactgctgctgatgagagccatctgggcgaccttcgacatggcaaggtgcgagccatctgatcagccttagacatggcaaggcaagagccatctggtcaaccttagaagtgacaagggacagccacctggtcgacctttgacatggcaggatgacagccatctggtcgaccttagagatgggaatgcaagaggcttcaggtccaccttcaacatggtaaggctaaagccatcttgtccagcttagacatggcaaggcaagagccatatggtccaccttagtcatgggaaggcaagagccatcttgttgaccatagacatggtaaggtgggagccatcaagtctgcctcagacatagcaaggtgagaaccatctggtcaacctcagacatgggaaagtgagagccatctgatctacttcagacatggcaaggcaagaggcatcttgacctcagacatggcaaggaaagagccatccggtcgactttagagatggaaatgcgaaaagggtttgggtccaccttaagcatggaaaggcaagaggcatctggtctagtttaggcatggcaaggcaagagacatatggtttaccttagtcatgggaaggtgagagccatctggtcgaccatagacatggcaaggtgggaaccatcaagtccacttcagacatggcaaggtgaaagccatcttggtcaaccttagacataggaagttgagagccacatggtctacttaaggcatggcaaggcaacaagcatctggtcaacctcaaacatggcaaggcaagagccatctggtcaacattagagatggtaatgcaagaggcttcagatccatcttagacatggtaaggcaagaagcatctcatctagcttagacatggcaaatcaagagccatgtggtccaccttagtcatgggaaggtgagagccatctcgttgaccatagacagggcaaggtgggagccatcaagtccacctcagacatggcaaggcgagagccatctagtctgcctcagacatggcaaggtgagagccatctggttaactttagacatgggaaggagagccaactggttggcctcagacatggaaaggctagagccatccagtcgacctcagaaatgggaaagagagagccatctggacaaccttaaacatgacaaaatgagagccatctggtagactttagacatagaatggcaagagccatctggtcaatcgtagatgtggcaaggtgagagccatctgattgacctagacatggcaaggtgagagacatctggtcgactgaagacaaggaaaaatgaaagccatctggttgagcttagacatggcaaggcaagagtcatctggccgaccttagacatggaaaaagaagagccatctgtttgaccttagacatggcaaggcaagatccatctggtcaaccttagacatggcaaggtgagagccatcttgttgaactcactcgaagaggagacccatctggtcaacctcagacatggcaaggtgagagccatctgatcgaccttagacatggcaaggtgagagccatctggtcgaccttagatatggcaaggtgagaatcatctggtcaatcttaaacatggcaaggtgagatccaacttgaccttagatatgatgaggtgagaaccaactgttcaatcttagacatggctaggcaagtgccatctggtccaccttagatatggcaaggcgagagccatctggtcgaccttagacatggcaaggtgagagctgtctgttcatcttagacatgacaagctggcagctaaatgcgatgcatgcagtcgacatccatctcaaaataaatgaaccaacagtaaatatataacaataacaaggaaataatagtgaacaaccctaaagaccaaataattaagtaggagtgtacaataataaaaggtaattaatgtcgcaatttaaaaaaactcctctctctctctgtctctctctctatttgtcacacacagggtgaagtgtaaccaaaaaaaaaaaaaaaatccaaaggtcaaactcagtttgcaggaaggagcataggagaataaaggatggaacaaagaagaaaaagaacagcaagttactctgagtattgtggaaacaaactgaaattagagtgagagagagagagaaaaaaaaagaaggtccgagcaatctcagatatatgagaggccaagatgggaagatcacttgggtaagactgggaagattgagtctgcagtgagtcacagtcgcatcattctgctggatttgaatggtactgcttctggcccaagttgtctgggcaaccttagacatggtaaggcaagagccatctgatcaacattagacatggcaaggtgaaagccatctggtcgacagggattctaatagaagacactctgggccgatggcagacgtctaataatagagacaaagggtgagcccggacattttaatgggagagaagcctggatgaccccaggtattctaatgttagaaacacctacgtgactccaggcctcctaatggtggagactcccagcctaccccaggcattctcttgtgagagacttctggctgaccccaggcagtctatttatggagacacctgggagaccccaggcattctgggaggaactcctggccaaccgcagggagtctaatgatagaaacacctgaacgaccacaggaattctaatggaagagacccctggcaggccccaggcagtctaatgatagaggcacctgggtggccccaggtattctaaccagagagactcctggccaaccccaggcagtctaatcatagagacacctgggtgaccccaggcattctaatgagaaagactcccgtgtgacagcaggcagtctaatgatagagacacctgggtgaccctaagcattctaataggaaagactcctggctgaccccaggcagtctaatgatacagatacctgggtgaccccaggcattctaatgtgagagatgccctgctacattcaggaagtctaatgatagagacaatttgacgaccccaggcattcaaatgggaaggctcccagccaaccccaggcattctaatggcagagactccccgctgaccctaggcattctaatgatagagacacctgggccaccccaggtatgggagaaactctcaggtaaactcaagtattctaacagaggtactcctggctggccccaggcagtctaatgatagagacagctgggtgaccacgggtgttctaatgggagagactcctggtcaaccccaggcagtctaattattaaagacacctgggctaccccagacattctaatgggagcaactcccgaccaaccccaggcagtctaatgatagagacatgtgggccatcacaagaattctaatggaagaggttcctggctgaccccaggagagacaccattctaatgggagagactctgggccgtttccaggctgtctaatgatagagaaacctgggcgactgcaggcattttaatgagagcggctcctgtccgaacaccagcagtctaatgatagagacacctgggcaaccccagacattctaatgggagaaaatcctgtgcaatcccaggcagtctaattataaagacacctgggcaaccccaggcattctaatgggagagacccccggctgacaccaggcattcttatgggaatgactcctggctgagccaggcagtctaaagatagagacacctgggcataccaaagcattctaatgggatagactaacggctgacccaaggtagtctaatgatagagacacctggatggccccaggcatactaatggaagagactcctggctgacaccaagcattctaatgatagagacaactgatcaaccctaggcattgaaatggaagagactccttctcgaacccaagcattctaataatagagacagctaatcaactacaggcattttggagaaactcccgatcaaccacagacattctaataatagagacacctgggcgaccacaggcattccaatgggagagactcctggccaacaccaggtggtctaattatagagacacctgggtgaccccacgcattcaaatgggagagactcctggccgaccccaggtggtctaattataaaaaaaaaaaaacctaggtgaccccagtcattctaatggcagagactatcagctgaacccaggtattctaatgggagagactcctggctgaccctagactaccttaggtagtctagttataaacacacctggccaaacccaggcattttaatggggaagactactggccaatccaaagcattctaatgatagagacacctaagcgactccaggcattttaatgggaaagactcccagccgacctgagacattctaatggaagagagccttggttgaccccaggcaatcaaagaatagtaacacctgggcgactccaggcattctaataggaaagagtcctagatgacaccaggaaatctaattataaaaacaccagggtgacccaaggcattgtaatgggagacactcctggcagaacccaacagtctaacgattgagacaccagtgcaactcaaagcattgtaatggaagagactcccgcagacaccagacagtctaataataaattcacctggacgacccaaggcattccaatgggaaagactcccagccgacaccaagtagtctaatgataaaaacacatgagtgattcccggcattctaatgggagaaactaccagttgatcacaggctgtatcatgatagagacacatgcattttaatgggagacacttctggctgacctggggcagtctaatgatggaaacacctgggcaaaaccaggtattataatgggagagactgctggctgaagccaggcattgtaatgatagagacacctgggcaatccaggcattctaatgggacagacctttggctgattccagggtttctaataatagagacacctggtcgacccctggctttctaatgggagagacttgtgtggaccgccaggcagtctaatgatagagacacctcggggaccccaggaaatccaatgggagaaacttccaggtgaccccattcattctaatgatagagacacctgggcgaccagatgcattttaatggaagagactcctgaacgacctcaggcattcttatgatagagacagttgggagaccctaggcattctaataaatcgaactcctgggcgatcacaggcagtctaagattagagacacctgggtgaccacagacattctaatgggagagactccttgctgaccacaggcagtctaaggatagaaacacgttagcattcgccaagacaccttggcgatcacaggcattctaatgaaagagactcatggccgaccctaggcagtctaataatagacatacttgggtgaccccaaaaattctaatgtgagagactcccagttgacgtcaggcagtttaataaatgtgagagactcccggccgaccccaggtactctaatgatagaagaacctgggccacatctggcattctaatggaagagactcctggccgaccccaggcggtctaatgataaacctgggcggcccaatgcattctaatgggaaaaactctggtccaaaccccagcattttaatgggagagactcctggctgaccccaggtggtctaactaaagagacacctgagagaacccaggcattctaatgggaaagactaccggccaaccccaggcattctaatgatagagacaccttgttgagcccagtctttctaatggaagagaatcccatccaacccaagacagtctaataagacacctgggcgaccccaggcattctaaagagacacctaggcgactccaggcgatattatagcagagactcccagccaacaccagacaatgaaagaaactcccagcggatgccaggcagtctaatgatagagacacctgggcaaccccaggcattgtaatgggagagactccggtccaatcccaggcattctaatgagagaaacacctggctgaccccaggcagtctaataatagagaacctgggtgaacccaggaatgctactgaaagagactcccggccaatctcaggcagtctaatgatacagacctctgtgcaaccccaggcattctaataataaagacttccagccgaacccagacagtctaatgatagagagaccttaacgtccccagacattctaacgagaagaacttcttgctgaccacaggcagtctaatgatagagacacctggacaactccgggcattctcatgggagagaatcttggccaaaccaaggcattctaattatagagacacctgggtaagcccaggcattctaatgggaaagactcttggccgaacccaggcattctaatgagagtctcctggttgacccaaggcagtctaaggatagaaacgcctgggcgactccagaaattcttatgggagagactcctggttaatcccaggcagtctaatgatacagacacctgggcaacacgaggaattctaattagagagactcctggcctatccagacagtctaataacaaagacacttggacaaacccaggtattctaacgtgagagactcacggccaaccccaggcagtctaaatatagaaacacctgggagacccctggcattttaatgaaaaagactccggtccgaccccagtcagtctaattaaaaagacacctgagtgacccccggcattctaacaggaaacactcctggctgaccccaggctgtcaaattatggagatacattgtctaccccaggcattttgatgggagagaatcctggccaaactcaagcattttaatggtagagacaactgggtgaacccaggcattgtaaggggataggttcttggccgacaccaggcattctaatgataggaacatcttgtcaaccccaggctttctaatgggagagactcccatccaaacccagggagtctaatgatagagacacctggaaagcattcaaatggaagaggtaccagctgaccccaggcattctaatgatagagacacctgagcgaccagtggcattctaatgatggagacatttgagcgaccacaggctttctaatgggtgacactcctggctaaacccagtgtgtctaatgatagagacacctgggagaccccaaacattctaatgggaaggctgccagcctaacccaggcattttaatgacagagacacctggtcgaccccaggctttccaatgggagagactttcatacaaaccaggcagtctaataatagagaaacctggttggtcccagacattacaaagggagagactcctggctgaccccagacagtctaatgatagagacatctggtgacaccacacattcaaatgagagagactccccactgagccaaggcagtctaatgatagagacacctgggcaatcccaggtgttctaatgggagagactcccgaccgaccccaggcgttctaatgagagagacttctagctgaccactggcagactaatgataaagacactggggtgaacctagccattctaacgggagagactcccagctgacaccaggcagtctaatgatagagacacttgggcgacaacaggcattctaatgtgaaagactcctggctgactcaaagctgtctaattatagagacagctgcatgaacccaggcattcgagagaaagatacccctggccgaccccaggcagtctcatcatataaaaacctgggcaattccagacattctaatgggagagactctcggccaacacaaggcattctaatgggagagattccttgcagacagcaagcaatctaacaatagggacacctgggcaactgaaggcattgaaatgagagagactcctggtcaaccccaggtaatctaatgaaagtaaaaactgggcgacccaaggcattctaacgaaagatactttcagccaacaccaggtggcctagtgacagaaacacgagtgacccccagaattttaatggaagagactcctggttgagcccaggcagtctaatgatagagacacctgtgcaaccctatgcattctaataaaaaagagtcaccaccgaccccaggatttctactgatagagacccctgggcaaccccagacattttaatgggagagattcctggccgaccccaggaaatctaataggagaaactgctggcctacctaagcagtatgagcttagagacacctgggcatccacaggcattccaatgagagaggattgcgccagcccaaggtagtctaaaaatagagacaactgggtgacctcaggcattctaatgaaagggaccccctgccaactccaggtagtctaatgatagaaacacctgggcgacccccgtcattctaatgggagagactcctggtcgaccccagacggtctaattatagaaacacctgggtgaccccaggcattctaatgatagagacacatgggcgacttcaggcattctaatggaaaagacaccctgcttaccccaggcattctaatgaaacagattcctggctgatattaggcagccctatcatagaggcatctaggctaccgcagaaattctaatgggagagactactaggcgactccaggcagtccaatgatacagacacttgggtgaccctaggcattctaatggcagagaaccctggctgaccccaggcagtacaataatagagacccctggacaaccctaggcatttcaatgggaaacactcccagctgtccctgaacattctaatgatagaggaaccttggagacctcaggcattctaatgaaagagactcctggctgaccccaggcattctaatgggagaaattgctggccaacctcaggccacctaatgataaagacacctgggcgaccacaggcattctaaagggagagactaccggtcgaccacaggctgtctgatgatagagacacctgcgtgagcccaggcattctaataatagagacgcgttggtgaccctcatcattttaataagagagattcctgggtgaacccaggcattgtcttaagagagactcctgactgaattcaggcagcctaattatagagacacctgggtgaaccgaagcattctaagggaagagatccttgaccaacagcaggcagtcttatgatagagacacctgggtgaccacaggccttattatgggagagactttttgccgaacttaggcagtctagtgatagagacagctgggccacactaggcattcttatggcagagacccctgaccaaccccagacattgtaattatagagcaacatgtttgaccccaggcattttaatgggagagactctcggtcaaccccagggatttttatgggagagactactggccaacacaaggtagtctaatgaaaaagacacctgggcaaccccatgcattccagtgggagagactcctggcccaaccaagttagtctaatagggacacctgggtaaccacaggaattctaatgggagagacccctaaccgacctcaggcattctaatgatagaaacacctgggcaaccacaggcattctaatgggggagactcccggccaacttcagccattctaatgggagagactcctggccgaacccaagcagtctaatgataaagacacatgggtgaccacaggcattctaacaggaaagactccaggtagaccccaggctgtctaaagatagagacacctgggcaaccacagacattctaatgggagatactgccagctgaccccagtcattctaataagacagacacctggctgaccctgggcagtctaatgataaagacatctggacgaccccaggcattctaaagggagaaactactggccgactgcaggctgtctaatgatagagacagctcctcgagctcaggtattcatgggagagattcccaactgacattagaatggcaggcattctaatgatagagacacctgggcgaccacaggtattgtaatgggagaggttccccatcgtccacactcattgtaatgatggaggcacctgaacgatctcaggtattgtcatgatagagacacctgtgcgaccccaggcactcaaatgggagagactcccagcagacaccaggcagtctaatgagagagattcctggctgaacccaggcagtcaaatgataaagacatctgggcaaaaccaggcattctaaagggagagactcctggctaaccccaggcagtctaacagtagacacctgggcgacctcagtcattctaatgggagaggctcagcccaccccagtgattctaatgggagagacttgtctgatcccaggcagtttaaggttagagactcctgagcaacacccaggcattctaatatgagagactcccggctgacataaggaagtctaaagatagagacacctgagcaaccagaggcattctaatgggagagactctcatgcgatcccaggcagtcttatgatagagacacctaggcaatcgcaggcattttaatgggagagactcccggtcatccagaggcattgtaatgatggagacatctggaagatggcaagcattgtaatgatagggacacctgtgtgaccccaggcacacaaatgggagaaactcccagccaacaccaggcattctaataagagagattcctggctgaccccaggtggtcaaatgataaagacacgtaagcgaaaccaggcattctaatgagagagactcctggctaaccccaggcagtctaataatagagacacgtgggcaaccccagtcattctaatgggagagactcccagccaccctcagtgattctaatggaagagactcttgtctgaccctaggcaggtgagattcctgggcgactccaggcattctaataagacaaattcccagcccaagcaagacagtctaaggatacacagctgagcaacatcaggcattttaatgggagagactcctggctgaatccagacagtctaattatacagactcctgggtgactgcaggcattctaatgaaagagactcccagctgaacccaggcagtgtgattatagagacacttaggtgaccccagacattctaatgggagagactcctggatgaccccattctaatgatagagacacctgtgcgaccccaggctgtctaatgatagagacagctggggaacctgaggcattcttatgggagaggcccagggccaaccccaggtattctaatgatagagacactgggcgacactagacattttaatgagagagacaaccaaccagcccaaggcagtctagtgatacaaacacctggtcgaccccaggcattctactgaaagaaactcctggccaaaccctggcattctaatgatagagacaagtgagcattttagtaatagagacacctgggctacaacaggcatttttttatgtgagagactcctggcaaccccaggcattctaatggagagactcctggctgaccacaggcagtctaatgatagagacacttgagtgaccccagacattataatggaagagactcctggccgacatcttgcagtctaatttaagtgacaactgagtgaacacaggcattctaatgggagagactcctggctgaccaaggcagtctgtggatagagacacctgggtgaccccaggcattctaatgggaaagatttctagttgaccactggcagtctaattatagagacacatgggagaccccgggcattctaatgaaagagactcctggccaaccccaggcaatctaatgatagaggcacctgggcgacccaaggcattctaatgggagagactcctggccaacctcagtgattgtaatggaaaagactcttgtccgccttcaggctatctaaggataaaagctccttggtacctccaggcattctaatgagagggactcccagccaaatccaggcagtctaatgatagagacacttgggtgaccccaggcattttaataggagagactcctgacctgccccaggcagtttaattttacacacttctgggagaccccagacattgtaatgaaaaagacccccggccaaccccaggcagtgtgatgatagagacaattgggctactccaggcattctaatgggagaggctcccagacaaccttaggcattctaatgatagagacacctctgtgactccagacagtctaatgggagtgactgcagtcaaacccacacattctaatgggggagactccctgccaacctcaggcagtttaatgatagagataccagggcgaccccaggcattgtaatgagagcgactgcttgctgacctaaggcaatgtaatgatagacacacctgggagaccccaggcattctaatgggagagattcctagttgaccacagtcagtctaattatacagacagcagggctaccccaggcattctaatgggataggctcctggcccaccccaggcagtctaatgatagagacatataggcgaccacaagcattctaatgaaagagactcctggctgaccccaggcagtctaatgaacagaagaaactcctggccaaacccaggcagtctaattatgcagagtcctgggagaccccaggcattctaatgaaaaagactcccagccaaacccaggcaaagtgatagagaaacttgggtgactgcaggctttctaatgagacagactcctggctgatccgaggcattctaatgttagagacacttgggcgaccccaggcattataatataatgatagagacacctttgccaccccaggcagtctaatgatagagatacattggcgaccccagggattctaataagagagactcttgcttaaacacagtgattctaatagaagagacttgtgtcctactcgaggcagtctaaggatagagactcctgggtgatcccagcattctaatgggagagactcctggcagaacccagggaatctaatgatagagacaccagggtgaccccagacattctaatgggtgagatttttggccgacaataggcagttcaattatacagactcctgggcaatccccagcattttaatgggagacactacccatggaccccaggcagtctaattatagagacaattgaatgacaccacacattctaatggaagacacttccggatgacccagacatcctaatgatagagacacttgtgcaaccccagccagcctaatgatagaaacacctgggcgactttaggcattcttacgggagagacctccagctgaccccagtaattctgatgatagagacccctggttgacccctgtcattctgatgggagaaactcctggctgacaaaatgtagtctaatggtagaaacatcttggcgaccccaggcattctaatgggagagactcctgacaaaactttggcattctaatgataaagacaagtgggcaaccccaagcattgtaatggtaaagacacctgggtgatcccaggaattctaatgtgagagactcctggccaaccccaggcattctaataaagagacttctgtctgaccacaggctgtctagtgatagagataccagggttactccaggcattctaatgaaagagactcctggcggaccccagacagtctatttaaagtgataacctgggccaccacaggcactctaatggaagagactcctggctgaccccaggcattctaatgggagagaatcctggccgaacccaggcagccaatggatagagacacctgagcaaacccaggcattctaatgaaagagactcccggccgaccccaggcagtctaataatagagacacgtgagtggacacaggcattctaataggagagattcctggctgacccaagcagtctaattatagacacctgggtgactccaggctttctaataggagaaaccccaggctgaccctaagcagtctgatgatagaggcttcttggtgacggcaagcattctaatgtgagagactctcggccaaccccaggcattctaatgatagagacatttgggagcccccagttattttaatgatagagacacctgagcgaccctaagcattctaatgggagacaacaaggctgaaaccaggctttctaatggggagacacctggctgatccccaacagtctaatcataaaaaacacctggatgactccagtcattttaatggcagagactcccggtctaccccaggtgttttaatggggagacttctgaccgaccccaggcagtctaatcataaagacagctgggctaagccagacagtctaatgaaagagattgccagccgaacactggctgtttaattataaagacacttgggcaatcccaggcgttccaatggaggagactcccagctgaccacaagcagtctaatggtattgacacctggaagtcccaagacattctaatggaagagattcccgtcctaccacaggcattctaatgatagagatacctgggccaccccaggcattctaatgggagagactcctggctgacaacagacagtctaatgatagagaaacttgggcgaacccagtattctgattggagagattctaggcagtctgatagtgacaactgggcaactacaggcattctaatgggagaggctaatggctgaccacaggcattttaattggagagaatcctgactgacccaaggaaatttaaggatagagacacccgggtgatcccagacattctaacgggagagactcctgaccgacaccagacagtctaattacagagacacttgggctatcccaggcattctactgaaagtgactcccgtttgactccaggcagtctaatgatagaaatacctggttgacttcaggcattgtaatgggagagacccccatccaatcccaggcagtctaatgatagagacagctgggcgaccccaggcgttctaatagagtatcggctaaccacaggcagtctaatgagagagacaacgtggagacctgattcattctaatcaaagagactcccagcgaaccccagtcattctagtaaaagagacacttgtccgacttcaggcagtctaagtatagagactgcggggcaaccccacacattctaatgggagagagtctgggccaaacccaggcagtctaattataggacacgtgagcgaccaaactcattctaatgggagaaactcctggcgggccccatgccacctaatgatagagacacttggacgaccccaggcattctaatgggaaagattcttggccgaccccatgctgcctaatgatagagacatctgagtgaacccaggcattctaatgagagatgctccttgcctattccaggcattctaatgacagagacacctgggcaaccccaggcattgtaatgatacagacatgtgggcgatttcaggcattctaatgaaagagactccctgcggacccaggcattctaatgagagagactctcagccgatctcaggcagtctaatgatagagacactggagtgaccaaaaggattttaataaaagagactaccgggcaaccacaggcacagacaatctaataatagagacacctgggtgactttagacatttcagtgggagagactcccagccggccccgagcaatctaatgatagagacacctgggaaacctcatgtattctaatgggagaaacttttggctggccccagacattctaatgggagagactgctggccgaccccaggcagtctaatgatagagacaccttggccacccccgtattctaaagggagagactattgacagtccccagattttttaatgatacagacacctgcgtgagcctaagcattttaaaaggagagactcttggtgaccacagacattctaataatagagacaccttggcgattccagtcattctaataggaaagactctcttctgaacccaggcattgtcttgggagataatcctggctgaacccagacagtctaattataaagacacctgggcaagcctaggcattctaatgggagatacctccccagtgtccccaggcagtctaatgatagagacaccttgacgaccacaggcattattatgagagacacactttgccaaactcaggcagtctaatgctagagacaattgggcgacaagcattctagcgggaaaaactcccggctgaccccaggcattgtaataaaagaaaagcctgagtgatcccagccattttcatgggagagacacttgttcgaccccaggcattcttatgggagggactactggccaacaccagacagtctaataaaaaagacatgtagatgaccccatgcattctttttttttcacactttaaatactttatttatataaaaactcatttgtttttaaaagcattaacaagacagaaagaaaagagaaaaagtatggagcagaacacaagcccgttagcagtgttcggtgggaaggtgggatttttggttctctggaattgaatgtttagtgtttttataaacaaaagaggaaaaaaaagttaaaggtccccaaaagcccatggctatcctattacccataccccactgagaagggagggggcagggatagcattaggagatatacctaatgctaaatgacgagttaatgggtgcagcacaccaacatggcacatgtatacgtatgtaacaaacctgcacgttgtgcacatgtaccctaaaacttaaagtataataataataaaattaaatatatatgtgtgtatatatatatatagcagttctggaagacaaaaaaaaaaaaaaaagaaaaaaagaaaaaagagcaccaggaaaagagcagaagagggcaagagaaatcaagagtggagccaggtctggatggggcaatttcacctgtgcagtgtgcccttagggtcacagagagcacaaggctcctttttgccagaaaaggtagatgaaagtggggagaaatgggaagggagaaaagggtaaataagaaattttaatgcaccagtaaagggggtggtgggttgtgcacttttctcctaccccatagcctcaatatataagggaaggggaagagagggataaagaactccagttacatggaacagagcttttagattagattaaggggagtagaaggcaaataaggaaaaggatcaaaaataataataataatcaacccgcatagcagctgatttctctagcccaacctgctaattaatatatgctaaagtgagagggggcaatactggagggagggaaggattggagagaccacttccctgtaacgccttcagagatgatggtaagttctgggcacctaaggagtaagagtcacaccactcacttctcttaccaaccttactttgtgattcatcagaataggagttttgcaaaatcccacgcatatgctgttgagcaaaacttgctatggctgaaatcatggctataccaatcctcaatgaagaatctgaggttctctaggtcacttctcttctttctgctatttagggccaatagtaggtaagaaagcaacaaaatgtaatttgcaaaattatgagaaatgagactgcagaggcaaagaaaggcacatggaagggtgggtggaaatgcaccccaggccaaaggcacaaagaagaggcaaagccaggggcaatccgcaccttgtaagggtaaaagggacaggagttatgtacatcaagtcctttagtgtgccagccaatccagggcagaggcaagggacaggcctataaggataggaaaaggagaaacaggggagtgaggaagccagtttcagacttaatttcttcatgtacattcctactagctcttcctagaggtcttcttctttgcaaaaacacatctttctgctccttctcaaccaaaagtcttccttgacattctcccctttctacagcctcttggacatggccaggccaactcaacagacatatcacagggcaggagaggtgggttaaggacagcctctgtttaaggggcagcagcaatagcccaggcttggcatgaggcttgcagaagagatggagtctgtaggttcttgatggtccctgccttggaggtgaggacagcaaggtttcttaatcccagttctaggagaccttcacttactcaagggtcctttgccaggtggcatgtgccaacgttgctagccttctttgcttcaaaaatagccattaggaataagggaagagctcacactttcccctctctaaaagaaaataaaagccccttccccaccaggaaaacaatcttgattaagaatcatcagtttatcagactgctggacattgcatatagagcatgtaacttgcaattcttcccacggcttctagtgaagattcccattctgtccatccttccctccacaaaaggccaggagttccagggagaactggcaaaaagaactaatctgcagcagtttctcaaaatatgcaaataatcgagtcatgcttcttgggagaaaatggagagaatgggggagggggaggcattgagacaattaaatttcactggaagaagttgggagttgatggaaagaaggcagccatttagggctgtaagggcaggaggcagcctggcagttggcacaatagtccagggaagaaaaaggaaaatcatcagccaatttcaccaccaaaaagtaaaagtacatataagcccagatggaacagagatagtggtgctaaatcttctgcatcaagggtgttgttcctttcaatggctccatgtaggcgaccccatgcattctaataagagagactcctggctgaacccaggcagtttgatgatagagacacctgggtgacaacaggcattctaatgggggagacacttggtcaacttcaggcattctaatgagggagattcctggccgaccccaagcagtttaatgatagagatacctgggagaccccaggcattctaacgggaaagactccaggctaaccccaggcagtctaatgagagagacgcctgggtgactccaggcattttaatgggagagactccctgctgaccccaggcattcaaatgggagaggctcctggctgaccccaggcagtctaattgtaaagaaatccggaccaccccaggcattctaatgaaacaaactaccagccaacctcaggctgtctaatgatagagacaccttcgcgagcccaggtattctaataggagagactcccagctgaccccaggcattctaatgatagagacacctgggagatcccagtcattctaataggaaagactcccactcaacacaaggcattctcttgaaagagactccttgctgatcgcaggcagtctaattattgagacatatgggcaatcccaggcattctaatgggagagacccctggctgaccacaggcagtctaatgatagaaacacctgggcgaccacaggcattcttgtaagagagatccgatgccaaacttagttgggcaaatccaggcattttaatgggagagactgtcagccgaccttaggcattctaatgatagaaaaacttgagcgaccccaggcattttaaagggagagactcttggccgacctaagacattctaatgggagagacagctgaccggccccatggagtctaaaaatagagacacctgggtaaaaacaggcattctaatgaaagagactactggctggatccaggcagtctagggagaaagaaacctgggtgacccaaggcatttcttttgagagggactccttcttgacctcatgctgtctaattatatagacacatgggagaccccaggcattctgatgggagagattcctggctgaccccaggcagtctaatgatagagacacatggggaacccaaggcattctaatgtgagagacttctgggtgacccaggtagtcttatgatctagacacctgtgcaattccagacaatctaatgggagagacttttggcaaaacccagacattctattgaaaaattctgccggctgatcccagacattctaatgaaagagactccagggtgagcccaggcattctaatgatagagacacctgggcaacaccaggtgttctaatgggagagaaacctggccaacccatggcattataatggcagagactccgggacaatcacagggagtctaacaataaagacacttgggcaaccccaggcattttaatgggagagattcctggccaaccccagtcagtctaatgatagagtcaccagggcaactgcagccattctaatgagaaagattcctggtcgactctaggccatttaatgatagagacttatgggcgacctcaggcattctagtagtagagagtcccggctgaccccaggcattctcatgggagagactcctggatgaacccaaggattccaatgatagataaacctggtccaaccgaggcagtcaaatgataaagacacctgggcaatgccaggcattctaatgggagagactcctggcctagcccagccattctaatgatagagaaaagtgggtgaccccaagcattttaatgatagagacaccttagtgaccccaggccttctaatgtgagagactcctggccaacccaggaattctaatgaaagagactgctggctgactctaggcattctaatgatagagacacctgggcgattccaggcaatctagtgatagagacacttcacaacagcaggcattctaatggagagaatcctggctgaccccaggcagtctaatgagagacagctgggagaccccaggcattctaacagcagagactcccagtcgaccacaggcattcaaatgtaagagactcctggctgaagaaagcagtctagggatagagacaactgggtgtccacaggcattttagtgagagagaattttggccgatgccaggcagtctaactatagagacacctgggtgaccccaggcattctaatgggagagatttccggctgaccccggggagtgtaatgacagagacacctgggtgactgcaggaattctaatgggagagacacccggctgaccacaggcagtctattgatagagactactgggcaaacacaggcattctaaaggaagatattcccctctgacctcaggcatttcaatgggagagactccggtccaaccccaggcagtctattgataaatacacctgggtgacccaaggcattctaatagagattcctggctgaccacagacagtctaatgagagagacagctgagtgacccaagacatactaatgggagagactcctggccaacccctagcattctaatgacagtgatacctgggagactgcaggcatcctaatgggaaagtctcctggctgaccaaaggctgcctaattaaagagacatctgggagaccaaaggcattctaataggagagactttcagccgaccaaaggcattgtactgggagagacttctggctgaaacaagcatgcatagagacacctgggggaccccaggcatagtaatgggtgagattcctggctgacccctggaagtctaattataaaaaacctgggtgacttcaggtattctaatgggagagacttctcgctgatcccaggcattctaatgagatacccctcatcaatttccattactttaagggtagagactcctgggtaatcccaggcattctaatatgagagactcccagccaacaccagacagtctaataatagggacacctaagcaacccctggcattctaatgggagagtctctcatccgaccccaggcagtcttataatagagacacctgggcgaccacatgcattctaatgggagagactcctggtccccctgaggcattgtaatgaaagggacacctgggcgaccccagacactcaaatgggagagactcccagctgacactaggaattctaatgagagagactcctggcctaccccacgtggtcaaatgttaaaaacagctgggagcaacaacaggcattataataggagggactcccggcaaactccagtgaatctagcgagagagacttttctctgaccccatgcagtctaaggataaatactcctggatgactccaggcattttattaagaaagactcctggccaagtccaggcagtctaaggatagagacatctgggtgatctcaggcattctaatgagagagacttctggccaacgccagggagtctaattatatagactcctgggcgaccttaggcattctaatagaagagacttgtggccaaccctaggcagtgtgatgatagagacacctgggcaaccccaggcattctaataggaaagactcctggacaaccccaggcatcctaatgatagagacacctgtgctaccccaggcagtctaatgatagagacacctggccaactgaggcattttaataaaagactcctgcccgaacccaggcagtctaatgataaagaaacttgggtgaccccaggcattctaatatgctggggtctgtcctgcagaccctgactcaacaacgaataaataacatacactgacacagatcttatgcttgtcagtcctgccaaatgtctgggccatttacggactccaaggagagtcctgtcagccacagccccgactcattggccctcccagcatttatttagcacacattcaatgacagaagtcccaagtaaacaccactagaaggtaattactgttgctgagccacagagtagagagcaatcatgcacccgcggatggtcagaggttagttttagaaccatatgagtaaacaagctatttagataaactactctacattcctatgttagttacccttgctatagttcaaagaggattaggccatcttcagcaaagctatctgaagctatgcaaacccccctggccttccaagaaggtttatgttttataattttcccacctatcctgactgaaaccctgcatctcccccttttctgttttctgcattaggtctttttgattggagaatgcagatgtatgcagcaacaggtttgtaaggcatggcagccattgcttttattccggctttgcatcctagaattagcaaatcacataatgtaatcatgattataattagcaacattattttccagtcaaagagtgacccatagtgttacttggcatctcagttcactctatgccatcaatgaggaaccccaccgggagaatgttaatttcttttagccaagcagtctcactgttagaagctctgaagggggtgtttgttaagtaacagggcataaaaaagggtggatttcagagatgagcttaatagagtgtagcaagtactggttgcaggcagagtgagagaattaaaaaggaataaattatttggcttagccttatgcctcttcagcataatgtctggggcctgcatcatccatggaagctgcatcgtctggggctgcaggtcctgtagggtcttttttagactggctcgggttttttcttctttccatcatttgatgaggacgtagtctccaggctcgtgctagtgtactggaaattctaggggtggtgcctgtgctaagagaccttttataatctttgttaaagagcaggttagtgctttaagaaaaacctgttgtgctttattttgaagtctggtttacaaaaaaactggacgataccttttttaactttagccaatatgtttctgtctgatctcagaagctaagccaggcaattttctccatttctggtactgggttgtgtcctagccacaccatggtatggtttaatgcattgtgctggaatccaaagaggacctgagggtgtggaaaaacaagcataccctcttccccacgttaacaattcatttggaccataccattcgtttctgtttacatcttcccataaaactgcaggttttatgtcttctgaggttattgcaaagtgcttttctgcagctgattgaactttgtcatctaaattttaaaacttaagagtaaataagacttgtgccaataacattacaagaactttacccatactccctcttttctgttttttgagcatatttttaatgatggagtgggcacgttctactatggcttgtccatatatgggatgcgtgtggaatattggatattccatgtgtgacaaaattgttgaaattgtgagctggcataagctggaccattatcagttttaattttggtgggcagtcccataaatgcaaaagttaaaatatgtttaatgacatatcgagttgactttccaggcagagcatgtgcactaattaagtgagtgttggggttctagtcctcaaaagttaatacctgtggaaggaggggatgtgcttgtgagctgacaatccaggcattgcaggataatttgtttagccagtctctgggtaagttgaaattgtttagataaatttctccaattttggtggaaaaattgatgcgatttggtggcttggtcaagcagtgatgtcatgacttctggatcaacttgttaattttctttttcttttttttttttttttgagacagagtcttgctctgtcacccacgctggagtgcagtggcactatcccagctcactgcaagccccacctcccgggttcatgccattctcctgcctcagcctcccgagtagctgggactacaggcatccgccaccgtgcccagctaattttttttgtattattattattatttttttcttagtagagatggggtttcaccatggtctcgatctcctgacctcgtgatccgcctgcttcggcctcccaaagtgctgggattacaggcgtgattcaccacgcctggccaacttgttcattttcataagtcaatgggccaggaagagagctgtgggctccaatgcatgtgataaaaataggatgtgtacttagatctagtaattgctgaagttgaagaaaaagagcacacaggatgggctcaagattggatttaattaaggctgttttaaggttctgcaataaataaacaaagtaagctgagtcactcactatattgataggctgagtggaaaaagtttccaagaccagtatcagggccccatttcagctctctgagtgctagtaagcccagattgagtgactgaatgatgtggtctccaccagactgtcacttttccatgtttacaggaaccatcagtaaatagtgttaaagcattaggtatgggggagtaaactatttttgtgggcaagattactggcatatgagataagaaatgaagaagtttattagcaggaagttcatgctctatttgtcctgtgtaatcagagaaagctatttgcagatatattgataagcgcaatactgcttcaaattgctttttacttaaaggaatcctgatgatatcaggatcataacctagcagctgattgcatcgtttgcagcctgaatagatgactttagtaatgaactgaatatagggagatagcgttttagtcccggtatgtgagcaaaaaacccattctaggaagtgtggcctgggggctatttgccctattaaccctgtaggggagtgtttggtgggaaagataaacaatttaattgaataaggtgaatcaatgcgatttagctgcctctgagaggtggcttgctctatttcctcgatttccctttctgctgcaggggttaaatatctgggagaatccagggctggattgccctttaagatagaaaacaggttgtatagcttatcagtaggaattcccgaagtgggttgaagccatttaatatctctcagtaatttttgataatcatttaaggtatgtaagttgctggtatttaatttaaacttctgaggttttactcaccaggcagttagtatgtacccaacatatttccaaggagaagaaatctgtactttcccaggtgcaatgattagacctcttagctgtgtattctttatgacagaggaatataaatttaaaatattggctcctttggagcttctagtagaatatcatccacaaaatgaatatttgtgcaatcaggaaattcttttctacttgggagcaaagcttgatttacatgatactgacacgtggtgggactgtttagcattccttgaggaaggattttccaatgaaatcaacaagctgacttttcgttattgatagctggtattgtaaacgcaattttttctctgtcctgctaggggaatcatataaaagaatgtcttatgtcaataacaattataggcaatcttgaggaattgccctgggcgaaaggagcccctgctgaaggggtcccacaggttgcaaattggcattaatagcacgtaggtcatgaaaaagttaccatttcccagacttttggggaatgatgaaaatgggtgaattctaagggctgctagataattcaacatgcccagctttcaattgctctccaactaattcatgggccctctgtaatttctctcattcagaggttacagttttattttaattagatgtggagagagtcacgctaggggcaagcaagagataacagtggctattatcagaaagaggtcttttaaattcttaaattttacttaaatcttagcagagaattataatttgggacgtctctgtatacaataaacacatgaaattttgtcgtgggccgcctgcggagctgtagagctgagcgggcaggtccgggggcagcggctgcgatgtgcttgctcaggccctgccgcttcttgtctgcaccgcttctttctgcgtgtgccgctccctcctcccgccaccgggtggctgctgcaggttgggtgagccttcccgcgcacaccttctgcccctcagtagcaggccgctctggtgcactggacctggcttttcgtcaacacagctgctacgcaggccaagttttggggagcatttgctggcagtgtttgctttctatttactgcatgcttgaccgcagcactctggcctctaatgctttttcttaaccctttaggtacctgattgccttgctgaccttgcattaccaggcaggctaaaagctccccttctaatgccgcttgattagacagggtctcataggtgtagcgtgtctcctgtcctttttcctatctcttggaggaggtggctcaggaaaaaccccgtttcctttttgttattctggcccggtgatatatccgggctgaaggaaaaggaggtggtaacgcaggttacggttcctccttcccctttttaggctcttctgtgtataatggagcctggtccagcctaattacagcccatagcgctagaggtgttactgggactcattgcccttgtgcataatgctgtttaagatttctccccacttgttccgagagctttatgtctagcgtgcctttttctgggaaccataggctttggcttataacagtttgcattaggtcatttaattgagcctgcaaaactgaggctccactagccttaagcagctgtttcaacacttttatgtactgtttctgttgagctgataactgttgtctcatgatgaaacctcagcctgaacaatctcccctgaacttggagatcctgagtgggcaccaatgacttactgattgctcgctgatgacaaggttcctttttcaccttcgttttcagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggtaaacaccactagaaggtaattattgttgctgaacccccgagtagagagcaatcatgcaccagtggatgatcagaggttagttttaggaccacataagtaaacaagctatttaggttaactactctatgttcctatattaattacccttgctatagttcaaagaggattaggccaccttcagacaaagtatttgaagctatacaaaaccccctggccttccaagaatgtttgtgttttatagttttccccagcatcttgactgaacccctacactaatgggagaggctctgggacaaaccctggcattctgttggtagaaacaactgggcaaacccaagcattttaatgatagagacaactgggcgaccacaggcattctaatgtgagagactcctggccaaccccaggcattctaatggagagactcctggctgaccacaggcagtctaatgatagagaaacctgggcaacccaggcattctaatgggagagactcctgggtgaccccaggcagtctaataaagtgaaacatgggcttaactaaacattctaatgggagagactcccagccgactaaaggcattctaacgggagagactccttgccgacccaagcagtctatggatagagacatcttggcaaccccaggcattcaaatgggagagattccaggccaaccccagcagtctaataatagagccacacgagtgacagcaggcattctaatgggagagactcctggctgaatccaggcagtctaatgatagaggcacctgggcaaccccaggcattctaatgaaagagactcctggctgaacattctagtgggagagactcctggccaaccccaggcagtctcagagaaacttgggcgactccaggcattctaatgggaaagactccaggccaaccccggcagtctaatgatagagacacctggacaaccccaggtattctaatgggagagactcccagccgaccccaggcattcaaatgggagagactcctggccaaccccaggcagtctaatggtaaagacatccagatgatcccaggcattctaataggagaaactaccagccaaccagaggccgtctaatgatagagacacctcggtgagaccagacattctaatgtgagagtcttctagctgaccccaggcattctaataatagtgacacctgggagaacacagccttcctattgggagagactccaactcaaccccaggcattctcttgggagagacttcttgctgattgcaagcagtctaattattgagacacatgggcaaccccaggcattctaatgggagagaaccctggctgactgcaggcaatctaatgatggagacactgggaggccacaggcattcttattggaaacacccgtggttgagcccaggcattctaatgatagagacacctgggggactccacgcattttaaaaggagaaactcccaggttacccaacacattctattgggagggacccctgatgaaccccaggcattttaaagggagagaccctggctgacccaagacattctaatgggagatacccctgatggaacctaggcagtctaagagtagagacatctgggcaacaacagacattctaatgaaagagactcctggctgaatctaggcagtctaaggataaagaaacctggggtagccatgggttttttttttttttttgagactcatggctgaccccaggcaggctgtctaattatagagacacatgggagacctcagccattctaatgggagacactcccagctgaccccaggcagtctaatgatagagacacctgggcgacccaaggcattctaatgtgagaaacttccagtcgaccaggtagtctggtgatatagacacctgggtgattccagacaatctaatgggataaacttttggcaaaacccagacattctaatgggaaagattgccggcggatcccagatattctaatggaaaagcctcctggccgaactcaggcagtctaatgatagagacacctaagtgaccccaggcattctaatgggagagactcccatctgacctcaggcagtcttatgattgagacacctgggcaaccacaggcattctaatgggagagactctcagtcatcccgaggcattttaataatagagacacctgggcgacctgaggcattttaatgatagaaacacctgtgcgaccccaggcactcaaatgagaaagactcccagctgacaccaggcattctaataagggagacttttggccgaccccaggtggtcaaatattaaagacagttgggcaaacccaagcattctaatgaagagaatattatctaaccccaggcagtctaatgatagagacacctgggcaacaccaggcattataatgggagagactcccaaccaacccaaggcagtctaatgatagagacaccttggtgaccggtgaccgcaggcattctaatgggagcgactgcttgccaaccccatgcagtctaattaaagtgacaagttggtgaccccatgcattttaatggaagagactactactggtcgtcccaaggtattgtaatgacagagacacctgggtgaccccaggcatttcaatgatagagactcctgtggaccccaggcactcagatgggagttattcttggctgacaccaggcattctaatgagagagacccccagccgaccacaggcatcctaaagatagagacacctgggtgacaccaggcattttaatggaagagactcccaaacaaccccagacagtataatgacagactcacctaggcagccccaggcattctaataggagagactcgaggccaaaccttggcattcaaatgatagagacaagtgggtggctccaatcattttcaggataaagacacctgagtgaccataggaattctaatgtgagaggctcctggccaacctctggcattctaatggagagacaactggctaagcataggcagtctaatgatagagatacctgggtgatcccaggcattctaatgggagagacccctggccgaccccagtcagtctaattaaatagacacctgggtgaccccaggcattaaaataagagagactcctacccaatctcagacattctaatgggggagacttctggcagtttattgatagagacacctgggcgacctcaggcattctaataagagagattcctggccgaccccagacggtctatgcatagggacacctgggcgattccaggcattataatgggagagtcttacggttgaccccaggcagtctatggatagagacaactgggcgattgcaggcattctaatgcaagagactctctgccaacccgaggcattctaatgatagagaaacctgggagaccccaggcattgtaattatttaggcaccagtgagaccccaggcattctaatgggagagaattttggttgacatcagacattctaatgagagactcctgtctgatgccaggcagtctaacaatagagacacgtgggcaacccaggtattctaatgggagagacttccagtcatccctagacagtctaatgatagagaaactgggagacccagacattttaatgggagagactcctggccaacccaagcagtctatggatagagacttgggtgacaacaggcattctaatgagagagatttctggcccaccccaggcattctaatgatagagacaagtgggcaaccccaagcatttcaatgatagagacacctgggcaaccacaggtattctaatgttacagactcagggctaacctcagacattctaatggagagattcctggctaagcacaggcagtctaatgatagacatacctggactaccacaggcattttaataggagagactcctggccgactaaacgcagtctaattaaagtgacaaatgggcaactcctggcattctaatgggagagactcctggccaactgcatgcagttttattaaaaagacacctgggcgaccccaggcattcaaataagagagaatcctagctgacccaaggcattctaatgggagacactcctggctgacccaagcagtctgttgatagagacacctgggtgactggaggcattctaatgggagagattcctggctgacctcacacagtctaattatagagaaacttgggtgaccccaggcattctaatgggagagactaatggccgcagtggctggcatgaaattaaccaaccctgggtttagtatagcttaaactttcatttattgctaggctgaccccaggcagtctaatgatagagacaaataggcaaccgcaggcatttcagtgaaagagactcctggatgaccacagacagtctaatgatagaggcatctgggtgaccctaggcattgtaatgagaaagacgcctggacgacctcaggcagtataattaaagacccctgggtgccaccaggcattctaataggagagtctttcggctgaccgaaagcattctattgggagtgactcctgtttgactccaagcagtctatgcatacagaccacctaagcgaccccaggcattctaatgaaatacatacctggccgaacccagacagtctaattatagagacactttggcgaccccaggcattctaatgaaagagactttcatctgacatctgaaagtctaaggatagagactcctgggcgaccccaggcattctaatgggagagagccctggtcgaacccaggaagctcaattatacagactcctgggcgaccacaagcattctaataggagagactctcagcccaccccaggcagtctaaaaatagaggtacttgggccacccaagtcattctaatggaggagactccccaacgaccccaggcaatctaatgttagagacactaatgaaagatactcccagacaacaccagtcagtgtgatgaaagagacacttgggtgaccccaggtgttcttatgggaaagactctcagaccaccgcaggcattctagtgatagggatacctgtgcaaccccaggcagtctaatgatagagacacctgggaaaccccaggcagtctaaataagagacacctaagcgaccccacgctttctaataaaagagactcccaggcgacccaaggcattttaatcagactcctggccaaaccctgacaatctaatgatggggacaagtgggccaccccaatcattttaatgatagagacacctgagtgaccccagacattctaatgtgagagactcctggcaagctccagcgattctaatgggagaaactcttgtctggcttcaggcagtctaaggatagggaaatttgggtgactgtaggcattctaatatgagactcccagccgaacccaggcagtctaataatagagacacttgggggacctcaggaattttaatgggagaaacttttggctgaccacatgcagtctaatgatagaaaaccctgggtggccccaggcattctaatgtgagagacttttggccaaccacaggcagtctaattgaagtgaaaggtgggtggccccaggcatgctaatgggagagactcctggctgaacccagggagtccattgatagggacctctgggtgaccacacacactctaataataacgactcttggacgaccccaggcagtctaattaaaatgaccactgggtgacctgaggcattctagtaggagagacttagccggcccaaggcattctaatggaagtgactcgtggcctacaccaggcaatctatgcatagagacacctaagggaccccaggcattctaatgggatagattcctggccagccctaggaaatctaataatagagacacctgggcgattgcaggcattctaatgcgggagactcttggcagacatgaggctttctaatgatagggacacatgggcaacccaggcattgcaatgatagagacacctgtgagaacccaggcactctaatgggagaaactttccgttgacaccaggcattcgattgagagagactcctgtctgacaccaggcagtctaatgagagagaaacctgggagagactcttggctgacccaagcagtctatgggtagagacacatgggtgaccccaagcactctaatggggaagatttctagctgactccaggcagtctaatgatagaaacacctgggcaaccccaggcattctaataagagatactcctgtgtgaccccaggcagtattatgatagagacacctggtgaccgaaggcattctaataagagagactaccgatcgtcccgaggtattgtaattatagagacacctgggtgaccccaggcattgtaatgatagagacatctgtgtgaccccaggtattcaaatgggagagactcttgactgacaccaggcattctaatgagagagactccaggaagatccaggcagtctaatgataaatatacctgggcgaacccagccattctaattggagagacttctggctacctcagtcattctaaggtgagagactattattcgacttcaggcagtctagggatagactcctggtccaatccaggcattctaatgtgagatactcctggcagtacctaggcagtctaatgatagagacacttggtctaccccaggcattttaatgggagagactccttcctgaccccagtcagtctaattatacagactcctgggacaccccaggcattctaatgaaagagactcccaaccaaccccaggcagtgtgatgataaagacacttgggctactctaggcattctaatgagagagactcccaaaagactttaggcattctaataatagagacacctctgtgaccccaggcagtctaatgatagagagaactgggcaaccacagtcattcttatgggagagacctccagccaaccacaggcattctaatgatagaggcacctggatgaaactaggtattttaatgggagagacacccaagccaacaccagacagaataatgatagagacacctgggcgacctcaggcattctaatgggagacactccaggctgaaccctggcatgctaatgataggggcacgtgggtggccccaagcattttaataatagagacacttgggtgaccacgggcattctaatgtgagagactcctggctaaactcaggcattctaatggagagacacctggctgaccacaggcagtctaatgatagagacacctcggtgaccacaggcattctaataaaagagactcctggccaaccccagacagtctaattaaagtgcaacctgggcgacctcaggcattgtaatggaagagattcctaagtgacctcaggcagtcgaattaaaaagacaggtgaatgaccccaggcattcaaataaaagagactcctagctgacaccagactttctaatgggagagactcgtggctgacccatgcagtctgttgatgagacacctgggtgaccacaggcattctaatgggagagattcctggtggaccccacacagtctaattatagagaaacctgggtgaccccaggcattctaatgggagagactactggccgaccccaggcagtctaattttagagaaacatgggcaatcacaggcatcccaatgaaagagaaacctggatggccccaagcaatctaattatagaggtacctgggtgaccccaggcattttaatggaagagactccaggccaaccccaggcagtctattgatagggacaactgggcgaccagaggcattgtaatgagaaggagtcctggacgaccccaggcagtctaattaaaaagacccctgggtgcccccaagcattctaataggagagactttcaggtgacagaaggcattctaatgggagtgaatcctggccaactccaggcagtctacgcatagagacacctaaacgaccccaggcattctaatgggaaagattcctggcctaacccagatagtctaattatagagacacctgggcaaccccattaattctaatgagagactttcgtccgacccctggcaatctagaaatagagactccttagtgatcccaggcattctaatgagacagactcctggtcaaactcaggcagttcaattatatagactcctgggtgaccccacacattctaatgggagagactctaagctgaccctaggcagtctaatgatagagacacttgggtgaccatgggcattctattggttgagactccctgacgatcctaggcattctaatcttagggacacctgtgcaaaaccaggcagtctaatgttagagagacctgggtgaccccagccattcttacaggagagacccccagccaaccccaggaattctaatgatagagacacattggcgaccccagtcattctaatgggagagactcccggatgacacaaggcagtctaatgatagaaacacctgggcaaacctaggcattctaatgggagagacttcccacagaatcttggtgttctaatgatagagacaactgggcaacctcaagtattttaatggtagacacacctgggcaaccccaggcactctaatgtgaaagacttttggtcattaccaggcattctgatggagagactcctgggagaccacaggctgtctaatgatagagacactggacaaccacagaaattcaaatggaggagacttctggcctaccccaggctgtctaataatagagacacctgagcaaccccagacattttaatgggagacactttcatctgaccccaggcagtattacaatagagacacctggagaccacaggcattctaatgggatagaatactggtcgtctcaagtcattgtaatgagaaagaaacctggatgccccaggcattgtcatgatagagacatttatgctactctaagcactcaaatgggagagaatcttggctgacaccaggcattctaatgaggtagatattaggatgatcccaggcagtctaatgatagagacacctgggcaaactcaggccttctaatgggagagactcctggctacccaaggcagtctaatgatagagacacctgggcgaccccaaatattctaatgaaagagattcccagttgacaccagatactatgatgttagagacacttgggtgaccccaggcattctaatgggaaagaatcttggaccaccccaggcattctaatgatagagatacctgtgcaactccaggcagtctaatgatagagacacctgggcaaccaaggcagtcaagataagggacaactaagtgaccccaggcaaacctaggcattctaatcagagagactcctggctgaaccccagcattctaatgatgaagacaagtgggccaccccaatcattgtaatgatagagacatctgggcaatgcaaaggattctaatgtgagagactcctggtgaaccccagtgattctaatgggagagactcttgtcaaacttcaggcagtctaaggatagagaaacctgggtaactccaggcattctaataagagagactccataacgaacccaggcagtttaatgatagagacacttaggggaccccaggcattttaatgggagacttttggctgaccacaggcagtctaatgatagagacagctggcgatcccaggcattctaatgtgaaagaagtttggccggccataggcagtctaatgaaagtgaaacttgggctaccacaggcattctaatgagagagactcctagctgacctaaggcaatctgataagagacacctgggcaatcaaaggtattctaataatagagactcccatccaacccaaggcattttaatgggagagacttctgacggacccaagcagtctattgatagagacacctgggagaccccagacattttaatgggagagactcccagccaataccaggcagtctaatgaaacaaacacctgggtgaccgaaggtgttctaatgggagagactctcagccaaccccaaaaatctaatgattgagatacctgtgcgaccccaggcattctagtgggagagacccatgtctaatttcaggcagtctattgatagagacaaatgggcgaccacatgcattctaatgggagacacttctgctcaactccaggcattttaataggagaggctcctggccaacccaaagcttgctaataacagagacacctgcttgaccccaggcattctaatgtgagagacttttggcaaactgcaggcagtttattgatagagacaccttgacgagcacaggcattctaatggaagagacccctggctgaccccaggcagtctaattaaagagacacctgggtgtcttcaggcgttctaaaaggggagactcccagcagaacccaggcattctactgggagagacttctggctgaaagaggcagtctatgcatagagacacctgggaaactccaggcattctaatgggagagattcctggctgaccccaggtaatctaattatagagacacctgagagacctcaggcattctaatggtagagactccctgctgactccaggaagtctgatgacggagacatttgggcgactgcaggcattctaatgacagacactcccggccgaccccaggcagtctaatgatagagacaactgggtgaacacagacattctaatgagagaaactcctggtcaacttgaggctttttaatgatagagacacctgagtggccccaggcattgtaatgatatagacacctccacgacaccaggcactcaaataagagagactcctggccagcaccaggcattctgatgaaagagacacctggccaaacccaggcagtctaatgatagaaacacctgggtgaacccaggcattctaatgggagaatttcccatttaacccgaagcagtctaatgatggagacatctaggcagcttcaggcattctgataggagagggtcctggccaaacccagtgattcttatgggagagaatcttgtctgaccccaggcagtctaaagatagagactccttcatgaccacaggcattctaatgggagagacgttctgccaaacccaggcagtctaatgatagagacacctgggtgaccccaagcattccaaaggaaaaggctcctggccaaccccaggcagtctaattatacagatttttgggtgactccaggcattctaatgagagagactcctggccaaccccaggcagtctaatgataaagacagttgggctaccccaaactttctaatagaagagactcctgcatgaccccaggcattctagtgatagagacagctgagcgaacccaggcattctaactggagagaatccagaccaactccaggcagtctaatgatagagacacctgggccacccaaacattctgatgaaagagactactggccgacttcagatagtctaatgatagagccacccgggtgatcataggcattctaatgggagagactcctggccaaccccaagcattttaatgataaagacatttgggcaaccacaggcattctaatgggagagaattttggctgaactcaggaattctaatgataaagacatcttggcaaccctaggcagcctaatgataaagacacctcagcgaccccaggtatttttattagagaggccccccaatcctggcattctaatgataaagacacctgaacgacccaaggcattttaatgggagagattcctggctgacccctggcaatcaaatgatagagactcctgagtgacctcaggcagtctaatgatagagatatctggctgtccacaggtatttttatgggagagaccccagtcagccccaggcattttagtgatagtgaaacttgaacaaccccaggcattctaatgggagaggctcccggctgaccccaggcattctaatgatagagtcacctaagtgacctcaggcattctaactttagatattcccagcaaacctcatgcattctgatgggagagattcctggctggccccaggccatctaatgatacagacgcttgggcaattccaagcattctaattaaagagactcctggctgacaacaagcagtctaattaaagagataccagggtggccccaggcattctaatagcggagaaccccagctgacaccagagattctaatcagaaagacttccagctgaaatcaggcagcctatatagacaccttggtgacccaaggtattctaatgggagagactcctggccaaccacaggcagtctaatgatagaaacacctggaagagcacaggaattttaatgggagagagttttggctgaccccaggcagtcttacgattgaaatacctgggagactccaggcattctaattttagagactcctggcaaaccccaggcattctaaaaagagactcctagtaaccacaaacagtctagtgatagagacacctgggaaaccataggaattctaatgggagagattcttggcccaaccccagcattctaatgatgaagaaaagtgggtgaggcaaagcattttaataatagagacacctaggtgaccccaggccttctaattcaagaaactattggccaacaccaagcattctaatagagagactgctggtgaacacaggtgtcctatgaatagagacacctggatgatcccaagcattctgatgaaagagactcttggccgacaacaggcaatctaattatacagactcctgagcaacagcaggcattctaatgggagagactcctgactgaccccagacagtctaatgatagaaacatctgggtgacatttctgagtcttttgaaacctatagtaaaaaactgaatatcccactataaaaacaagaaacaagctctctgattaaatgctttgtaaattgtgggttcacctcacagagttagaactctattttcattcaaagggttagaaacactttttttgtagaatctatgaaggggcatttctgagtccattgaggcctctagtgaaaaactgaatatcccatgataaaaacaacaaacaagctatctgtgaaagtggtttgcaatgtgaacattcatctcacagagctaaatcaatcttttgattcaacaggctggaaacactctttttgtagaacatacaaatggacatttctaagcacattgaggcctataatgaaaaatcaaatatcccacaatgaaaactagaaggaagctatctgtgataatgctttgtggtgtatggattcatctcactgactgaaacctgagttttgattcaccaggtaagaaacacttttttttttaatagaatctacaaagggacatttctgagcaaattgaggctaagagtaaaaaatcaaatatcacacgataaaaactagtaacaagctatctgtgaaaatgcttttcaatgtttgaattcatttcacagagttaaacctttgttttgattgaacaggttggagacactctttttataggatctaccaagagacatttctgacctcattgaggccaatagtaaaaaatcaaatgtctcatgataaaaagtaaaaagatgctatctgtgaaaatgctttctggagtggagatttatctcagtgaattgaatctgtgttttgattcaccaggttggaaaccttctttttgtaaaacctacagtgggacatttctgagctcattgaggcttgtagtgaaaaactgagtttcctgcaataaaaaccgaaaacaggttatctgtgaaagtgatttgtgatgtgcaaattcatctcatgaaaataaacctctgctttgattgaataaatgggaagaacttttttgtagaaatttctgagctcctttaggtctatagcaaaaaaatctaatatcctgcaaacaaaactagaaacaagctacatgtgaaggtgctttctgatgtgtgaattcatctcaccaaatgaaactcgtgttttgatttagtaggttgaaaacaatctttttgaagaatatacgaagggacattactgagcttattgaggcttatattgaaaaactgaatatcccacaaaataaactagaaacaagtgatctgtgaaaatagttggccatgtgtaaatttatctcacacagttaaaccctttttttgactcaacaaattagaactctttttgtagaatctatgaagggacatttctgagctcattgaggcctatcgtgaaaaactgaatatcccatgatgaaaactagaaagaagctatctgtgaaaatatttagcaatgtgttctttcatctcacagagttaaatctttttttttttttattcaccatattggaaatactctttttgtagaatctacaaagaaacatttctgagcccattgaagcctatagtaaaaaaacaaatattctgcagttgaaactagaaacaatctctttgaaaatgccttgtgatgtgtggatgcatctcattaaaaggagcctgtgttttggttcaccagattggaaacacttttttgtagaatatacgatgggatgtatctgagcccattgaggcctatagtaaaaaatggaatatcttgcaataaaaaactagaaacgagctatctttgaatatgctttctgatgtgtggattcatctcacagagttaaaccttatttttgactcaccaagatggaaatacttttttttgtagaatctatgataagacatttctgagtctattgatgtgtatagtgccaaacagaatatcccacaataaaaactagaaacaagctatctgggaaaatgccttgtgatgttttcattcatcttagagagttaaaccattgttgtaattaaacaggttggaaacactctctttgtagaaactacgaattgacatttctgagccctttgaggcctacagtgaaaaacagaatatccagtgattaaaactaaaaactttctgtctgtgaaaatgctttgtgatgtgtggaagcatctcatagagttaaacctttgttttggttcaacaggttggaaacacttttttagtagaatctatgagaaaatctttgtgaacccaatgaggactctgtgtgtgtgtttgtgtgtggggggggtgggggggcaggaaacaacgaggatttcatgatggaaactggaaagaaccatctgtgaaaatggtttgtgatgtgtggattcacctcacagaattaaacctttggtttgatagaacagattgaaaacactgtttttgtacaatctaaaaagagacatttctgagcccattgaagcctgacgtgaaaaaccaagggtctcacaataaaaacgaattacaagctatctgtgaaaatgcttagcaatgtccggattcatctcactgaatagaccctgtgttttgattcaccaggttggaaactctttctgcagaatctgcaaagaaatatttctgagcccattgaggcctacagtggaaaactgaatattctgtgataaaactagaaacaccctatctgtgaaaatgctttgtgatgtgtggatttttctcatcgaatggaacctctgttttgactcacaagggtgaaacactattttagtagaatctaggaagaaacatatctgagcccatttatgcctacagtgagaaactgaataccctgcaataaaaagtagacagaagctatttgtaaaaatgctttgtgatgtgtggattcagtgttaaacttttattttgattccacagttttgacaccctatttgtagaatatatgaatgaacatttctcagcccattgaggcctatcatgtgaaaccaaatattttataataaaaactggaaacaagtgatctgttaaaatgttttttagtgtgtgaatttgtttcacaaagataaatctttgcatggattcaacaggttggaaacattattgtagaacctatgaagggatgtttttagcctattaaggactatatatataaaaaaaactagaaacaagctgtctgtgaaaatgctttgtgatgtgtggattcatctcacagagttccacctttgtttttattcaacaggttaaaaacgctctttttgtagaacctacaaaaagacatttctgagcccattgaggcctacagtgaaaaaccaagaatcccataatacaatctagaaaacaagctatctaggaaactgttttggatgtgtggattcatttaacagaatggaaatagtgttttgattcaccatgtttgaaacactctttttgtggaatgcacgaagaacattctttgtggaagaacattgatgcctatagtgattaaccaaatatcacgtgatgcaaactagaaacaagctatctgtgaaaatgccttgcagcgtatggattcatgtcacagagttacacctatgttttgattcaacaggttggaaacaatctttttgtagaatctacaaaggaatatttctgagccaattgagttctagagtgaaaaacagaatatcctgtgataaaaactataaataagctctctgtgaaattgctttgagactgtggatgcatctttcagagttatgcccttgcttatattcaacaggttggaaacacttttcttgtagaatctatgaagggatatttctgaacctattgaggcctatggtgaaaaattgaatattctgcgatataaaccagaaacaagctctctgtgaaaatgcttttccatgtgtgcatccatcttacagagttaaacgtttgtttagattcaacaggttggaaatactctttttgtagaatctatgaagggatatttctgaactttttgaggcctattggcaaaatccgaatattacgtgataaaaactagaaacaaggtatcagtgaaaatgctttgtgatgtgtgggtttatctcaccaaataaaacctgtgtcttgattcaccaggttggacacacttttttttctataacctacatagggcgatttctgagcctattgaggtctatagcaaagcaacaacaacaaatatcctgtcttataatctagaaagaagttatctctgaaaatactttatgatgtgtgaattcatctcacaaagttaaacctttgttttgattcaactgattggaaacactctttttgtaaaatctatgaagggaaatttctgagcccatttaggcctatagtgagaaacagaatatcccactgtaataagtagaaacaagctatctgtgaaaatcatttatggtggctggattcatctcaccaaatgaaacctgtgctttgattcaccagtttggaaacactatttttatagaatctatgcaggaatatttctgatcccattgaggcatatgctgaaaattcgaatatcccatgataaaaactacaaacaagctatctatgaaaatgttttgtcatgtgtggattcatctcacagagttaaacctttgttttgattcatctgtttgaaaacacgcttttttgtagaatctaagaatcaacatttctgagtgcattgaagcctatagtgaaaaacaaaatatctgatgataaaaactagaaacaagctatctgtgaaaatgctttgtgatatgtggattcatctcaaagaattaaactttattttgattcaacaggctggaaacactgttttcgtagaacctacaaaaagacattggggagcccactgagtcttacagtgataaaccaaggatcctgtgataaaactagaaacaagctatctgtgaaaatgctttgcagttggtgaatttctttcatagttaaacctttttttattcaatacgttggaaacaccattttttagtgtctctaaagggactttttcagccctttgaaacctatagtgaaaaaccaaatatcttgcaataaaaacaaataaacaaaaaagaactacttatgaaaatgccttgtgatgtgtggattcatctcacagagttaaaccattgttgtgattcaacaggttggaaacatgctttttgtagaatctacgagttgacatttctgagccctctctgggttatggtgaaaacgaaatatcccatgataaaaactagaaacaacctatctgtgaaaatgctttgcaatgtgtggattcatttcacagaattaaaccattgttttgatttaacaggttggaaacactctttttgtagaatgtatgaagagatatttctgaggcctgttgtgaaaaactgaggtttccacaagaaaaactggaaacaagttatctgagaaaatgctttatgatgggtgaattcatctcacaaaattaaaccttcgttttgattcaaaaggttggaataacttttcttttcttcttcttcttctttttttttttttttttttggacagggtcttgctctgtcacccaggctgaaatgcaatggcacaatctcggctcactggttcaagcaattctcctgcgtcagcctcacaagtagctgagaatacaggtgccagccaccacaactggcagtttttttgtatttttataaaagatggggtttcagcatgttaaccaggatggtctcgatttgctgacctcctgatctgcctgccttggcctcccaaagtgttggtattacaggtggaatcactttttttgtagaatctgtgcaggcacatttctgaggcctacagtgaaaaattgtaggcctcattgaggcctacagtgaaaaattgaatatccctcaataaaaattacaaacaagctatctgtggaaatgctttgtgatgtctggattcatctcacagagtgaaacctttcttttgattcattaggttgaaagcacactttttgtaaaaattacaaaggaacatttctgggcctatttaggcctgtggtgaaaaatcagaaaactagtgataaaatctagaaacaggcttgtgtgaaaatgctttgggttgtgtgcatttatctcacagagttaaacatttattttgatttaacaagttggaaacactctttttgtagaatctatgaggggacataattgagcttattgaggcctatagtaaaaatttgaggattctgctataaaaactagaaacaagctatctgtaaaaatgctttgctgtgtgtgtattcctatcacaaagttacagctttgttttgattcaacaggttgcaaacactctttttgcagaatctatgaaggaacatttctgaaccaattttggcctatagtggaaaactgaacattctgtgatataaactagagaaaagatatctgtgaaaatgctttgcaatgtgtggattcatctcactggatggaacctatgctttgatttagtaggttggaaatactcattttgtagaatctacaaaggatatttctgagcccctttgagcctgtagtgaaaaatcaaggatcccatgaagaaaaacagaaaaacactatctgtcaaaatgcttattggtgtgtggattcttcttaccaaatggaacctgtgttttgattcaccaggttggaaacacttttttgtagagtctatgaagggacatttctcagcccattgaggcctatagtgatgaacaaaatatcccataatagaagctagaaaaaagctatttccaaaaatgctttgcaatgtgtggatttatcttacagaattaaacctttattttgatttgacagtctgcaaacacttttttttgtagaaagtacagagggacatttctgagaccatcaagaactatagtaaaaaaatcaaacaacctgccttaatatttagaaacaagctatctgttaaaatgctttagaatattttcattcatgtcacagatttcaaccttttttttgattcaacaagataaaaacactcttttagttgaatctacaaaaagatatttcaaagtccgttgaggcctatagtgaaaaactgaatatcccatgataaaaactagaagtgagccctgtgtgaaaatgctttgtgatgtgtggattcatctcacagagttaaacttatatttttattcaacaccttggaaacactctttttgtagcatctatgaagggacattctgaggccattgaggcctatagtgaaaagcagaatatccttccttaaaatctagaaacaatctatctgtgaagatgatttatgatgtgagcatttatctcacagatttaaaactatgttttaattcaacaggtaggaaaaagtctttttgtagaatctatgaaaggacacttctgagcccacggagacctatagtgaaaaactgaatatccagcattaaaaactagaaacaagctatatgtaaaaatgttttgtgatgtgtggattcatctctcccaatggaacctgtgttttgattctccaggttggaaacactttttgtgaaatctatgaagcgacatttctgagcccattgaggcatattgtaaaatttgaatattccacgataagaactagaaacaagctatctctgaaaatccttttcaatgtgtggcttctcctcacagagttaaatctttgtttcaattcaacaccttgaaaacacttttttggtagaatctacgaagggacatttctgacccattgaggcctacagtaaaaaatgtagggacatttctgagcccattgaagcctatagttaaaaaactaatttctggtgataaaatctagaaacaagccatctgtgaaaatgctttgtgatgtatggatttatctcaaaaagttaaaactatgtttttaaccaacaggttgaaatcactctttttgtagaatctatgaaaagacgtttctgagcccactgaggcctgtagagaaaaactgtatatcctgcaataaaagctagaagaaaagctctccgtgtaaatggttcccgatgtgtgggttaatctcacagagttaaacatttgtttttatttaacaggttagaaacgttctttttgtagaatctacgaaggaatatttctgagcccattgaggcctatagcaagaagccatatatccgtcaataaaaactggaaacaagctatctgtgaacattttttgtgatgtatgcatttatctcaccaaatggaacctgtgttttgattcaccagtttggaaacactcttttgtggaatgcatgaagggacatttcttagccaattgaggtgtatagtgatataccaaatatcccgggatagaaactagaaacaagttatctgcaaaaatgctctgtgatgtgtggatttatctcacagagatgaagctttgttttgattcaacatgttggaaacactttttttgtagaatctacaaagggacatttctgagaccattaaaaactacagtaaaaaaaggtataatgcaccttaaaatctagaaacaaagctatctgtgaaaatgctttgcaatatgtggattcatgtcacagatttaaacctttgttttgattgaacaaattggaaacactgttttagtagattatataaagggacatttcaaagcccattgaagcctatagtgaaaaatcaaaaatcccgtgagcaaaaatagaaacaacctctgtgggaaaatgctgtgtgatacgttcattcatctcacagggataacctttgtttttattcaacaccttggaaacattctttttgtagagtctatgaaaaaaatttctgagccaattgaagtctgtagtgaaaaagctaatatcccattttaaaatataaaacaaactatgaaaatgagttttgatgtgtggattcatcgagagttagacctttgttctaaatcaacaggttaagaacactctttttgtagaatctatgaaaaaacatttctgagcccgttgaggcctattgcgaagtgaatctcttgcaataaaaagcagaaaccagctctctgtgaaataattttgtgatgtacaaatttatcttgcagagttaaaactttgttttaattcaacaagttgaaaccttctttttgtagaatctgcaaagagacatttctgagcccattgaggccaatagcaaaaaaatgaatatcccacaataaaaactagaaacaaaacagctgtgtaaatgctttgcaatatgtggattcgtctcactgagttaaacctatgttttgattcaacaagttaaaaaacttgtttttgtagtatcttcgaagggacaattctgagcctatggagattatagcaaaaaactgaatatcctgcaataaaaactagaaacaagatatccgtggaaatgctttgagatgtgtagatttatttcacagaattaaacctttgttttgatttaacaggttggaaccactctattttaagaatctatgaagaaatatctttgtccctattgtacactatagtggacaactgaatacttcatgacaaaaactagaaacaagctagctgtgaaaatgctttgcaatgggtgaattcatctcactcagttaaaccttcgttttgattcaacaagggtgaaacactcttttggtagaatctacaaagaaacatttatgagccccttgaggactatagtgaaaaaatgaatctcctgcattaatatctagaaacaatctatttgtgaaaatgctgtgtgatgcatggatccatctcacagatttcaaactttattttgattcaacaggctggaaacactcttgttatagaagctacgaagggtcatttctgaacccattgaggccaatagtgaaaaactaaatatcctgcaataaacctagaaaaaatctatctgcgaaaatactttgtgtagtgtggatgagtgtctcagggttaaacatttgtttttattcaccaggttcgaaacactctttttgttgaacagacaaagggacatttcttagcccagttaggcctataaaggtaaaccgaatatcccgtgatacatagtagaaacaagctatctgcaaaaatgctttgtgaattgtagattcatctcacagaattaagcctttgttttaattcaacaggttaaaaacactatttttgtagactctacgaagaaacatttctgaaaccattgaaacctatgggggaaaaaaacccccgaaattcctgtgataagaaatggaaagcagctatctgtgaaaatgctttgtaatgtgtggattcttctcacagagttaaacctttgttctgattcaacattgttcagaacactctttttgtagaatctacagagatactttttagcattttgaggcctctagtgaaaaaccgaatgtcctgcaatagaaactggaaacaaccttctgtgaaaatgctttgtgattcgtctattcatctcaaagaatgaaacttgtgctttgattcaacaggttggaaaaccctttttgtagaatctacgtaggaacatttctgagcccattgaggcctctagtgaaaaaactgaatatcccagaattaaaactataaacaagctatctgtgaagaagctttgtaatatgtgcattcatctaacagatataagcgtgtattttgatttgcctggttgggaacactctttttgtacagtctataaagaaacatttctgagtgcattgagtcatatgttgaaaaatcgaatatctcgtgataaaaactaggcaggaggtatctgtgaaaatgctttgagatgtgtgggtattggcctcacagagttaaacttttgttttgattcaacagtttggaaacatactttgtagaatctacaatgacatatttctgagcccattgaggcctgtagtgaaaaaccgaatatcccatgataaaaactcaaaacaagcgatatgtgaaaatgctttgtgacgtgtggttcatctcatagagttaaacctggttttgatccactacattggaaacactcttattgtagaatctacaaaaaaaaatttctgagaccattgaggtctctagtgaaaaactgaatatcccatgataaaaactagatacaagctatctgtgaaaatgctttgcaatgtgtggatttgtctcacaaagttaaacctgtgtttgattcaacgggttggaaacactttttttgtagaatctatgaagaaacatttctgagaccattgaagcctatagtaaaaaattgaatatcctgtgatataaatgagaaacaagttatctacgaaaatgtatattaatctcactgaatgcaacctgtgttttacttcaccaggttaaagatgctctgttggtaaaatctgtgaagggacatttctgagcacattgaggcctatagtgaaaaaacgaatatcctgctataaaaactagaaacaagctatgtgtgaaaatgctttgcaatgtgtggattcacctcacagatttaaacctttgttttgtttcaacaggttggaaacactctttttgtagttgaacgaagggacatttttgagtcccttgaggcctatagtaatgaacagaatatcctgcaataaaaattagaaagaagttatctgggaaaatgctttgtgttgtgtggacttatctcacagtgtcaaactattgtttccatgcaacactataaatgcacactttttgtagaatctatgaggggacatttctgagcccattgaggcctataaagaaaaaccaaacttcccatgttaaaagctagaaacaagctatttgcgaaaatgctttatggtatgtggattcatctcattgaatgaaacctgtgttttgattcaccacgtttgaaacactcttttgatagaatccacgaagggacatttcactgtatgaggcatatagtgaaaaaccaaatatctcatgatgaaaactagaaagaagctatttgtgaaaatgctttctgatgtttagattcatgtcaaagagttacaccatttttttgattcaacaggtttgaaacacttttttttagaatctatgagggacatttctgaacaaattgaggagtgtagtgaaaaaccgaatatcccactgtaaaaactacaaacattctgtctgtgaacatactcccaactgaccctgggtattctaatatgagagactcctggctgaccccaggcagtctaaggatagagactcctggcagactgcaggcattctaatgacagagacacctgtgcaactccaggcatcttaatgaaagagactttatgccgaccttaggcattcttgtgataggggcaactgtgcgtcttaagacatttttatgagagagactccaggctgaccccaggcattctaaggagagagacttcttgcagaattcagatactgtaacgatagagacactggggcaacctccaacattctaatgagagggacttctggtctaccacgggcacttcaatgataaagacagtttttcgacccctagcattttaataggagagactgccagccaaaaccaggcattcaaactggagagacacccagccaaccacaggcagtctaatgttagagacgcctggatgatcacaggcattataatgggagaaactgaatgccaaacgcaggcagtctaatgttggagatacccagccaaccccaggcattttaatacaaaagactcctggtcgaccccaggcattccaatgatagagacactgtggcgacccaaggtaatctactgggagagactccctgccaaccccagtgattctaatgggagagactgctggctgacaccaggcagtctgatagaaacccctgggcaaccccaggcattctaatgaaagtgattcctggctgaacttaggcaggctaataacagagacatctgggtgaccccaggcattctaatggtacaggctcccgggaaattccaggcattctaatgggagagactcttggccgactacaggcagtttaaggatagaaacacctgggcgaccacaggcattttaatggaaagactccatgctgacccaaggcagcctaattacagaaacaccgggtgaccccaggtattctaatggaagagactcccggtggaccccaggcagtctaatgatagagacacctgggcaaccacaggcattctaatgggagagactcccagcagagcccaggcaatcaaatgatacacctgggcgaccccaaatattctaatagaagagactcctagccaaccccaggcattctagtaagagacttctagccgacaaaaggcagtcttaggttagagacacctaggcaacctcaggcattctaatgggagagattcattgctgacccctgttagtctaacgatagagtcacctggggaacctcagtcattctaatgagatagactcctgccgaacccaagcagtctaattataaagacatttcggtgacccaaggcattctaaggaaagagactcctggtggatcccaggcagtctaataataaagacacctgagcaaccccaggcattctaacggaagagactcccagctgaccccaggcagtctaatgatagaactcctgggcaaacccaggcattctaatgggagaaacttctggccaaacctaggcagtataattatatatgccaaatcgaccccaggcattttaaggggagtgactcccagccgactccaggccgtctaatgatagagacacctgggtgaccctaggcattctaatgggagggactcaccgccgaccctgggcattctaatgggagagactcgtggcctaccccaggcagtctaatgatagagacacctgaaaaaccccaggaattctagtgggagagacacccgaccaactgcaggaaatctaatgatagagacaactgggtgactgcaggcattttaatggaagagactctcagatgacttgacgttttaatgatagagacacctgggcatcccgaggcattctaataggagagacttccagccaaacccaggcattcttttgaaagagatgtctggctgaccccaggcagtctgattatagagacacctgggtgacctcaggaattttaattggagagattcccggctgatcacaggcagtctaatgataaagtcatctatgtgacttaagacattctaatgggagagactccagaccgacatcagacattctaataatagagacacctctgtgactccaggcattctaacgggagagactctgggccgacaccaggcattctaataaaaaagactcctggctgaccatagactctctaatgatagagacatctgaacgacccttggcattctaataatagagactcccggctgacctcagggaccctaatggtagagacacctagctgatgcaggcagtcttatgatagagacacttcgatgaccggagacgttctaataagagagattcctggttgaacccaggcattcaaatgatagacaccttatcgaggacaggcattttaatgggagagactcccgccaaaccgcaggcagtttaataaagaaatagggatgaatacaggtattctaatgagagacactcctggctgacttcaggcagtctaacaatagagacacctgggagagcccaggtattctaatgggagagattgctggctgaacacaggcagtcaaactgtagaggaatctaagccacccaaggcattttaataggagagcctaccagctgaccccaggcagtctaatgatagagacacctgggcgaacccaggcatactaatgggagaaactcccagataactcaaggcattttaataagagacaatcttggcggaccccaggcagtctaatgttcacaactgggcaaccacaggcatcctaatgggagagactacaggacaagcccaggcatgcaaataatagatacacgtatgcgaccccaagcattctaatgagagagaattccaactgacaccagatattctaatgggagagactcctgcctgaccccaggcagtctaataatacagacacctggatgacctcaggcattctaattagagagacttctgtacaaacccaggcaatccatgcatagagacacctaggtgaccccagccattctaatgggggagattcccaactgaccacaggcagtctaatggtagaggcacttgggtgaccccaggcatcctaatagtggagacttccaaaggaccccagccaatctaatgttagagacacctgggtgacaccaggcattcttatgggagataccctccactgaccccaggaattctaataatagtgacacctgggataccacaggcattctaatgggagagactgctggctgacaccaggcattctcataatagagacacctgggggactccactccaggcattctaatgggggaaactctcagatgaccccaagcaatctaatgttagagagagctgtgcaaccacaaacagtctaatgttagagacacgtgggtgaccccagtcactccaatgggagagactcacagatgacagaaagcattctaatgggagatactcgtggtcaaccccaggcagtctaatgctagagacactgattgagcccagtgattgtaatgggagagactaatggtcgaacacaggcagtctaatagtagagacacttaggtgatcctagacattctaatggaaaagactatcatctgaccccaggcattctaataatacagaaacctgggtgacctaaggcattctaatgggagagacttccatctgaaccctggcattctaatgggaaagacaccaagccagcccaggcagtctaatgatagagacatctgtgtaaccacaggcaatctaatgaaagagactcccggccaatcgcaggcagtataatgacagagaaatctgaacgactgcaagtattttaatgggagacacttctggctgaccccaggcagtctaataatagagacacctgatggaccccaagcattctaatagaagagacttcgagctgaccccaggctgtctaattataaagacatctgggctaccttggtaattctaatgggtaagactcctggccaaccacaggcaattctaatggaagagactcctgactgacaccaggcagtctaataatagagaaacctgggcaatcccagacattcttatgggagagactgctggctgaacccagcagtctaatgatagagacacatgagcaaacccaaacattctaatgggagagattcccagccaattccatgcattctaatgaaagatctcctggccaaccccatgcagtcttaaaatagacacctgggcgacaccaggcagtcgaataagagagactcctggctgacaccaagcagtctaatggcagagacacctgggccaccccaggcattctaaaaaaaaagaatcccaactgacatgaagcagtctaatgatagacaactgggcaccacaggcattctaatgggagagactcccagtcgattccagacattctaatttgagagaatttgggagatgccaggcattctcattggagatatcagcgaccgacctgcaccagactaatgatgaaaatgcatccacgaacccaggcattctaatgggaggggctctgggagacctcatgcagtctaatgaaaaagacacctggatgaccttagacgttctaatgggagagactctggtccaaccctagactgcctaaggttagagacacctggtcaaccccagacattccaatgaaagagactcctggcccaattcaggcagtctaatgatagagacaccaatgtcacactaagcattttaatgtgagagactcctggctgagaccaggaagtctaattatagagacacctgggcaaccccaggcattctaacgggagagacttcaggctgaccccaggcagtctaatgatagagaaacctgggcgactccaggcataataatgggagagactgctggctgacccaaggcagtataatgatagagacccctgggcatgctatctgtgaaaatgctttaggatgtgtggattagtctcaccaaatggaacctgtgtattgattcaccaggttgaaaacactcttgctgtagaatctataaagggatatttctaagacaatgtaggcctatagtgacagaccgtatattttgcaataaaaaatagaaacaagctatctgtgaaaatgcttcatgaaatgtggatttatttcaatgagttaaaactttgttttgattcaataggctggaaagcctcgttttgtagtatctacgaaaagaaatttctgagctcattgagactggtagtgaaaaatctaatatcctgtgataaaaagtataaaaacgctatgtgtgaaaatgctttgccatatgtgagttcatctccaacagttaaaactttgttttgattcaacaggttggaaacacttttactgtattatctatgaagaaacgtttttgaggccattaagtcctacactgaaaaactgaatatactgcattaaacattctaaagaagctaactgtgaaaatgctttgcaatgtgtgtatttatctcacagagttaaaccattgttttgattcatcagtttggaaacagtttctttgtagaatctatgaagggacctttcagaggccattgaggcctataataaagaaacaaatatcccacaataaaacaagaaacatatagaaacaagctgtatgtgaaaatgctttgtgatatctggattcttctcactgaatcaaacctgggttttgagtcaccaggttggaaacactttttttgtaaaatctaggaagggaaatttctgagcccattgaggcacatagtgaaaaaccgaggatcctgtgataaaaactagaaaaacgcaatatgtgaagttgctttgtgatgtgtggattcgtctccccgaatggaatctctgttttgattcaccaggttggaaacaatgtttttgtagaatgtacaatgagacatttctgagtccatttaggcctatactgagaaacccaatatcctgctataagaagtagaaaaatgctatctgtaaaaatgctttgtgatgcatggattcatctcacagagttaaagctttgtttggattcaacaggtgaaaaacccttttttacagaatctacaaaaaacatctctgatcccattgaagtttatagtgaaaaacagaatatcctgtgataaaaagtagaaacaagctatccgttgaaatgctttgcaaggtctgaattcatctgacagagttaaacctctcttttaattcatcaatttggaaacacgcttttcttagaatctatgaagaaacatttctgacccaattgaaacctatactgaaaaatagaatatcccaaaataaaaccagagaaaagttatctctgaaaatggattgtaatatgtggattcatctaacagagttaaacctttgttttgattcaacaggttggaaacactcttgttgtagaatctatgaagggagatttctgggagcattgatgcttataataaaatacagagtatcccgcaatgaaaagtacaaacaacctatctgtgcaaatgctttgccatgtgggaattcctcttacaaagttacacatttgttttgattcaataggttgaaacactctttttgtagcatctactaaggaacatttcagagctcactgaggcctataatgaaaaactgaatattccatgttaaaaagtagaaacaagctataagttaaaatgctttgggttttctggatttacatcacagatttaaacttttgttttgattcatcaccttggaaacttgctttttgtagaatctatgaaggaacatttctgagctcattgaggcctatagtgaaaaacggaatatccagtgataaaaaccagaagcaagctatctgtggaaatgctttgtgatgtttggattcatctcacagagttaaatctttgttttaattaaacgggttggaaacactctttttgtagaatcaatgaaaagacatttctgagcccactcaggcctatgttgaaaaatcgaatatcccacaataaaaactagaaacaaggcaagtataaaaatgctttgtggtgtctggattcatcttagaaagttaaacctttgctttaattaaataggttggaaacactgttgttgtagaatctacgaagggacatttctgaggccttcgactcctattgttacacactgaatagcccatgataaaaactagaaacaagcttgctctgaaagtgctttgtaatgcgtggacttatctcactgaatgaaaccctttgtttgattcactaggttaaaaacactgttgttgtagaatctatgaagggacatttatgagtcaattgagacctacagtaagaaaccaaatatttcgtgataaaaattagaagcaagctatttgaaaaaatgctttgcaatgtgtacattcatctcaccaaatataacttgtgttttgaatcacctgattggaaatactctttttgtaaaatctccaaagggacatttctgagcccattgaggcctataatataaaacagactatcttgtgataaaaactagaaagaagctatctgtgaaaaatgcttgtgatatgttgattcatctcagagttaaattattattttgattgaacagcttggaaacactctccttgtagaatctagaaattgtaatttctgagctcattgagacctatagtgaaaaaccaaatatcccgcaataaaaaccagaaacaaggcatctatgaaaattctttgtgatatgtgcattcatctcacagtgcaaaactttttctttgattcaacaggttggaaactctgtttttgtaaaattaatgaaggcacatttctgagccctttgaaacctatagtgaaaaactgaatatcccaccttaaaaatgagaaacacgctattagtaaaaatgttttgcaatgtgtggattcatgttgtgggaagtcagggaccccaaatggagggactggctgaagccatggcagaagaatgtggattgtgaagatttcatggacatttattagttcaccaaattaatacttttataatttcttatgcgtgtctttactgcaatctctaaacataaattgtgaagatttcatggacgcttatcatttccccaatcaatacccttgtgatttcctatgcctgtctttactttaatctcttagtcctgtcagctgaggcagatgtatgttgcctcaggacaatgtgataattgtgttacctgcacaaactgtagagcatgtgtgtttgaacaaatatgaaatctgggcaccttgaaaaaagaacacgataagagcaattgttcagagaataagagagataaccttaaactctgactgctggtgagccagatggaacagagccatatttctcttctttcaaaagcaaataggagaaatattgctgaattctttttctcagcaaggaacatccctgggaaagagaatatgcacccaggggtataagtctatagatggcccccctgtgcgtgcccctcttttatggtctgtagactacaggggtgaaatagaccccagtctcccatagtgctcccaggcttattgggaagaggaaattcctgtctaataaattttagtcagaccggttgctctcaaaaccctttctcctaataagatgttatcaatgacaatggtgcccaaaacttcattagcaattttaatttcaccacggtcctgtggtcctgtgatctcgccctgcctccatttgccttgtgatattctattaccttgtgaagtacttgatgttcgtgacccacacctattcgtatactccctctccttttgaaacgccttaataaaaccttgctggttttacagcttgtggggcatcatggaacctaccaatacgtgatgtctaccccggacgcccagctttaaaatttctctcttttgtactctgtcactttatttctcaaactggccaatgcttagggaatataggaaagaacatacgtgactattggggcaggttccccaatatctagcacacacattgtctttcttttttcctaagtgcatgagggaacccgattccctttggtaggtgtggtgaaacgtcatcggcttggtccacagatacacttgttagaatccctgatgagtgatgagtagtctatgtatggtctgggttaactatgggtcatgcagagtctaagcatcatacttatatctgctatattaaactcctgttaaaacagggcagtgtccgagtaaccatggaaaatatggtcactctattcagggcagtggttctgtccttggtttcctgaaaaaggaaccatagatgtaaaagtgtgggattgtgttggtacagcattctggtagctggtctcagcagggtattatgttcctgtcactgtttggggtggttggtacctgctgtcttagtggtgtgtggatctcgtgaccccctgcagttgccacagttttctgccttttcctcagatcctccacctttccctcagccttcctctcccacagggcccccatctgatcagactctccctttggctactcctcccccacctaatgatgctgaaaattctatgtctaactatggtgactttggtttaaagttaccccctacttatcttcttttcacgaatttcatgaagagccagtacttgaaactcccacggctgcaaagcacacagcccagtaccacaggtatgctaattcttctctcttcaaatctctgaagtcagctaatggctccaggaccaaactacaatttacctatcattctccaggccctcccaccatacacttcagcccctcaccctcctgtcgtttcgtttcctcaaccagtcactttaccatccactcagattgcttctctatacccttcttcacacttgaacaacagtaatcaccagtatacttctgctcgttctgctcccccaatgcctctttctcacattctcatcctggtccgaccctctcaccctcagtttcccttaactgcacatgcttttcctgtcacttccatgccgactccatctcagatgcctactcttgaaacttcaatgcaatgcttattatgccaaaacaaagaaataagtggattagatgaatggacttctctggttgtgctagatccacctaacttccaagggttacaaatgcatctttatgtacctcttaatcttacctttttaaaagaatttaaggatgcttgtactcagtatggtcctacttctccttacgttaagatagttttacaaactttttgtactgaggtcactttacttcctttagattgggaccttttggcaaaagctgttctaaccccatgtcagcatttacaattctgtacctggtggtcagaggaggcctgtttgcaggctcagctaaatatgagtaatggcattctaattactcaggctcagctcacaggctccgataatttctctgatgcttatgcccaattaaactttgatgcctttaccacagaacaagtaacaaaggtgtgtatgagagcttggaataaattacgcactccaggccaagctcctgtttcttttaccatagttaaacaaggtcactctgaattattccctgattttttagctaaattacaagatgctgttgaaaaaatctgtctctgatgaagcacgctcaaggcattctccttcgtatattagcttttgaaaatgcaatccctgaatgtaaattggccatgcgttctgtccaacaacaaaatttacctgatcacgtgttgcctgcatatattaaagtttgtgaaggcattggatcagacacccacaaagctattctgtgggcacgggccatgaaggacaccaaccaaactggtcccattaattcttctcttggagcctgctataattgtggccaacttggtcatatttgaaaaaattgcactgttaaaaacttacaagaggccaagccagttcaacaaacatggccaaatgttgctcctactgtttgcccacgttgtcgcaaaggtaaactttgggcaaatatttgccactctaagtatgatatagatggaaaccccctaccacagtgacagggaaatagggagtggggctagtcccaggtcccagcatcaaacgggacacttccaactaagaccaacattgtgtttccacttcaggcagtcccaatgcaacccctagcacaaacaaatctacctacagcaaaaccaaatgggtcccagcttcttctgtctcactacaatgcttgtcaacctccacagtaggaggtgggatggttgatatctgtagtactattcctctgaatttacttcttgattctttgcccttgattgtccccacgggggtcactggccctttatctcaaggttcggtgggccgggtgttaggtagagcatccacctctgctaagggagtcaccattcaaactggtctcattaaatctgattccgttgacgagattaaattaattgtgtctgccaaggttcctgtttccattctggctggtgagtcaattgctcaattgcttttactacctaatatcattttaaacaaaagagataagacacatggccctgggatgggctctggcagtgaaaaggccgcttattggattaatgtaattgctaaacaacagcccacctgcaccatacacattgaaggaagaaagtttgagggcttagtagatactggtggtgatgtttctcttatttcctctagtttatggccttcctcttggcttaaacatcccactaacatgggactagtaggtgttggaaaggccaaggaagtttatgagagcacatttattttgccttgcactggccctgatggtcaaaagggtaaaattcagccctatatcatgccaattcccattgatctttggggtagagatttactggcacaatggcgggctgaaattaatattccacgtaactcttataatgctcccagtcagcatatgatggaaaatatggggtttgttcctggactcggtctcagaccacagcacgaggggattagtaaacccctcccagttactataaaagaaaacagggctggtttaggttatcctttttagtggcagctgctgccacgcctcctgatcctattcctttgcaatggaaatctgacacacctgtttgggttcagcagtggccgctttctaaagaaaaactgggagatttaaatcaattggtttctgagcagttgcaacttggaaatgtggaaccttctctttccccttggaattctcctgtgtttctagtaaaaaagaaatcaggcaaatggcggatggtaactgatttaagggccattaacactgtaattaaacctatgggggccgtccaacctggcttgcctgcccctgctctaatacctaaaaattggcctctcatagttattgatcttaaagattgctttttttcatattgctttacataaatcggattgtgaaaaatttgcttttactgtaccatctatcaataatcaggagcctgcagctcataattgttggaaagtacttcttcagggaatgctaaatagccctacaatctgccagctttatgttggacaagagctttcaccagttcaagcccaatttcctgaggtgtatattcttcattatattgatgacattttaattgctgcccccaatgataaagaattaattgactgttaccacattttaagccactgtgttacagaggctagattacacgtcgctcaggataaaattcaacagatcactcctgttcaatatttaggaatggtgatcgataaacaatgtattcaacctcaaaaatttcaaattaggagagattctttaaacactttaaatgactttcaaaaccttttgggtaacgtaaattatttaaaacctactttaggcattccaacttatgcgctgtgtaacttgttctctatgctgtggggagattccgatctccacagccccgggactttgacccctgaggctttactagaactggaattcatagaggaaagaattcagacctcccagttatctagagtacagccgtttcagccttttcagtttctgttttttgcttcatcacactcccctactggactaatagttcaacataatgatttaatggagtggcgtttccttcctcattctatgtccaaaactttgtttatgtagaccaaatagccatattaattgggcaggctcagtgtagaatacttcaaatttctagatttgatccaaatgtaattgtacttcctttaaattggcttgaagttcaatctgcctttcaacattctgtactgtggcaaattcacttggctgattttattggcgttattgacaatcattattcaaaaaacaaattgtttgatttttatataaatgacgtcttgggtggttcctcaattaaccaaagatcaacccattcctgaggccattacagtgttcactgatggctccagtaatggcaatgctggttacataggtcctacagacaaacttatttctacctcttatgcttctgctcaaaaggtggagttaattgctgtgattactgccttacaggatttcctcaaacctttaaatattgtctcagattctgcttatgttgtacatgccactaaaaatatagaaactgctgctatcaaacacattgataattctgaattggcttctttattttcaaggttacaacaggtggttcaccaacgtagacaccctttctatattacacatattgggtctcataccactttaccaggacccatgtctgctggtaaccataaagtcaactgtttggtctcttttacaacccaagaagctcaggagttccataatctcactcatgtcaatgccgctggattaaaagataaatttgctcttacctggaaacaggctaagtttattgttcacggctgctctcagtgccaggtcttcgtacttccaaatcaggaaccttgtgttaatcctagaggcctaactcctaatgctttatggaaaatggatgtgactcatgttagctcctttggcatactgtcatatgtgcatgtctctgcagataccttctcaggttttatctgggctacttgccaaacaggggaaggcagggcctatgttaaaaaaaatctgtattcttgctttgcagttatggggcttccatatcaaataaagacacaatgtccctggatatgttagtaaggcttttgattcatttatgcaacagtggggaatttcccatattactggaatcccttacaatcctcagggacaggctgtggtggaacgggccaatcacactttaaaaacccaattgtccaaacagtctgaacaacctaaacatgatttaactactccccactcccaattacatttggcattgtttactttaatttttttaaatgtttctaaagataatactctaactgcagctgaacgccattatacaggcaaaaaattttccttaaacgaaggcaaaccagtgttatggaaaaactcccaagccaatacctgggaatctggcacaattataacgtagggaagaggatatgcctggtttcaccaggagatcatcaatcccctgtctgggaacccaccagaagattcaagcttcgggtgaacactgacaatgaaaaccacagagaaaagacgtctgtgtcagagactaccttcagaagtggtaagatctgtgccaactgctcagaaaaaggcacaccaaatcacaatggatttaaatcaatcctccctgatggcaatggagacccatctaactaatcccacttctcctgattacctttctttttctccttacaaacctaaaaatctcaccatttctattagcctgaaaataacatccctctgttcttctcttcctccttcagccttcaatctcatttacactaggttttatttaatgattctcctccttatactttctgtctcaccagtttcctctcacactgatttacctgctacacataattattcttattgggcttatgtgcctcttcctccacttattcgacctctcaccagggtagatgctcctgcacaaatctacactaacgatagtgtgtgactgcctggagccacagatgaccgttgccctgctcaaccaggagaagaaggcactgcatttaatgttaccatgggttgtaaatacccgtctctgtgcctcagacatgcacctggttgcatccatctggaaactcaagtctaggctgcttatcttccggaaagatcaactacagataaaacaggacatttggtctctggcctctctctttctcctttaaaacaaatgaaaggaagaataatgggagataccccatactttcaatataaacctgcaggaaaatcgtgccctaaaaattttgagggcccatctaaaactttaatttgggaagattgtgttaactcacatgcagtaatattaaaaaatgactcatatggtttaataataggctgggcaccaaagggctatttaaaaaacaattgctcctctggtggaagggaatgcctggaggctacttattttttttcttattgggagaacaagaatcatcattctactttgcataggaggatcagcttatgctttcccttaaaatgggaagataaaggcattatcccccacccaggcctcgtatgatactccccattctgagcctgaacacccagaactttggaaattggctattgccatgtctggactgcaagtatgggaaaggaaaactcttctgactgtttttcccactactgtcccactctctccttatcaacgtagaacgagacattctgctttacttacctccaacctgactattcccatacagagttgtgttaagcccccttacatgctgttagtaggaaatatcaaaatttggacgaataatcaaactgtccaatgcattaattgtcatctatacctttgtattaactcccattttgactccaagagaagcataatattggttcgatcttaagaaggaatctggattccagtaactttacctagaccttgggaatcctccccctcaatacatttaattaatgaagtgcgacagcgaattctaaaaaggtccaagagatttgttttcactttgatcactgttatcatgggcctaattacagtcactgcaatgaccaccactgccggaatggcattacaccaatccattcaaacggcttattttgttaatgattggcaagccaattccacccaaatgtggaattcttaacaaggcattgatcaaaaattggcaaatcaaattaatgatttaaaacagtctgttatttggcttggagattgggtagtgagtttcgaacattgcatgcaaatgcagtgccagtggaatactttggatttctgcatcaccccatattcctataatgagactgatcattcatgggaaacggtcaaaggacaccttctaggtagggaagataatttatcattggacacaactaaattaaagaaacaaatttttgaatcctctcaagctcacttatccattctgcctggagctgaggtgttagatcaggtggcagaaaatctttatggattaaagcccacaacttggattaagtttattgggggctccactgtagtaaattttggaattatgtttctctgtttaatcggcttgtttttagtgtgccagaccagtcaaagaatcctgcatcaaaattgagagaacgaacaagccttcatcaccatggcacatttatataaaaagaaagggagagatgttgtgggaagtcagggaccccaaatggaggaaccagctgaagccatggctgaagaatgtggattgtgaagatttcatggacatttattatttcacctaattaatacttttaaaatttcttatgcctgtctttactgcaatctctaaacataaattgtgaagatttcatggacacttatcatttccccaatcaatacccttgtgatttcctatgcctgtctttactttaatctcttaatcctgtcagctgaggaagatgtatgttgcctcagaacaatgtgataattgcgttaactgcacaaattgtagagcatgtgtgtttgaacaaatatgaaatctgggcaccttgaaaaaagaacaggataacagcaattgttcagagaataagagagataaccttaaaatctgaccactggtgagccaggtggaacagagccacatttctcttctttcaaaagcaaatgggagaaatattgctgaattctttttctcagcaaagaacatccctgggaaagagaatacatgcctggtggtataggtctatagacggacccccaggaatgcctgtcttttatggtctgtagactgcaggggtgaaatagacccagtctcccatagcactcccaggcttattaggaagaggaaattcctgcctaataaattttagtcagaacggttgctctcaaaacctgtctcctgacaagatcttatcaatgacagtggtgccagaaacttcatcagcaattttaatttcaccctggtcctgtggtcctgtgatctcaccctgcctttatttgccttgtaatattctattaccttgtgaagtacttggtgtctgtgacccacacctattcatatactccctcccgttttgaaactccctaacaaaaatttgctggttttacggcttgtggggcatcctggaacctacccacatgtgttgtctcccctggatgcccaggtttaaagtttctctcttttgtactttgtccctttatttctcaagctggctgaagcttagggaaaatagaaaagaacctatgtgcctatcagggcaggttccccaatagattcacctcacagagttaaagcttcattttgattgaataggttgggaacatctgcagaacctatgaagagacatttctgagtctattggggcctacagtaaaaaaaaaacaaaaaacaaaaaaccctggatacaaactagaaacaatctatctgtgaaaatgatttgtgatatgtggattcatctcactgaattgagtctatgtaatgattcaccaggtaggaaaccctcttcttgtagaatctaagaacgtacatttttgaactctttgaagcctatattgaaaaaccgaatattttgtgataacaactagaaacaagctctctgttaaaatcttttgtgatatatggattaatcttactgaatggaaccagtgttttgagtcaccagattggaaacactgtttttgtagaatctatgaagtgacatttctgagcccactgggacctatagtgaaaaactgaatatcccaccttaaaaacgagaaacaagctatctgttgaaaatggctttgtagtgtgtgaatttattgtacttaataaaagttgtgttttgattcagcaggttgtaaacactccttttgtagtatctacgaagggatatttatgacattattgtggcccattgtgaaaaactgactatcctgcaattttttatgagaaataagctctctgtgaaaatgcattacaatatgtgaattcatctcacctaatggaacctgctttttaactcaccaaatgggaaactttatttttgtaggatctacaaaggaacatttctgagcccattgaagccaatagtgaaaaactgaatatcccatgattaaaaactagaaacaacctctctgtaaaaatgctttgtgatgtgtggattcatcttctgtaatgtaacctgcgttttgattgaccaggttggaaatacccttttttttagaatatgtgaagggacattttagcacacattgaggctgatagtcaaaaaccaaatatcccatgataaacactagacacaagctctctgtgaaaatgcttctcaatgtgtggattcatcccaagagttaaaaacactctttttttttttttttttttttttttttttttacaatttacaacaatacattatgagccacttgaggcctacagtgaaaaacagaatatcacaagataaaaaatagaaacaagccatctgtaaaaataatttatgatgtgtggatttatctcacgaaatggaaactttcttttgatttaagaggctggaaacactcttattctagaatctatgaagggacatttctgagcccattggggcctatagtgaaaaaacaaatatcctgccataaaaatttgaaacaagaaatctgtgaaaatgctttgtgatatatagatttatctcactgaatagaacctgcattttgacttaccagtttgggaacactctatttgtagaatctacgaaggcattgttcaaaattaggcctgagttccatgaggcctatagtgaaaaaccgaatgtcccaaggcaaaaactgtaaacaggctacctgtgaagatcttcagtttagtcggtgattcatctcattgactaaaccatgtgtttttattcaccaggttgggaacactgtgtttgtagaatctacaaaggaaaatttctgagcctcttgaggcctatagtgagaaatgatatatcatgcgataagaactaaaaacaagctatctgtgaagatgctttgtgacaagtggattcatctcacagagttaaacctttcttttgattcaacaggttaaaaaacctttctttttcttttgtagaatctatgcagggacatttttgtgctcattgaggcctactgtgaaaaaccaaacatcaggggtggagccaaaaaagccaaataggaacagctccagtctacagctcccagcatgagccacacagaagatggatgatttctgcatttccaactgaggtaccaggttcatctcactggggagtgttggaaagtgggttcaggacagtgggtgcaggacaccgagcatgagccaaaagagggtgaggcatcacctcacctgggaagcacaaggggtcagggaattcactttcctagtcaaagaaagtggtgacagatggcacctggaaaatcaggtcactcccaccataatactgcacttttccaatggtcttagcaaatggcacaccaggagattatatcccttgcatggcttggagggttctacacccatggagccttgcttattgctagcacagcagtataagatcaaactgcaaggtggcagagaggcttggggaggggcacccaccattgccgaggcttgaataggtaaacaaagtggctaggaagctcgaacttggtggagcccaccacagctcaaggaggcctgcctgcctctgtagactccacctccgggggcaggacatagccaaacaaaaggcaacagaaacctttgcagatttaattgtccctgtctgacagctttgaagagagtagtggttctcccagcacgcagctggagatctgagaatggagagattgcctcctcaagtgggtccctgaaccccaagtagcataactgggaagcaccccccagtaggggcagactgacacctcacaaggccgggtactcctctgagacaaaacttccagaggaacaatcaggcatcaacatttgctgttcaccaatatccgctgttctgcagcctttgctgctgatacctaggcaaatagggtctggagtggacctccagcaaactccaacagacctgcagctgagggtcctgactgttagaaggaaaactaacaaacagaaaggacatccacacaaaaaccccatctgtacgtcaccatcattgaagaccaaaggtagaaaaaaccacaaaaatggggaataaaacagaaaagaaaaactggaaactctaaaaattagagtgcctctcctcctccaaaggaatgcagctcctcaccagcaatgaaacaaagctggatggagaatgactttgacgacttgagagaagaaggcttcagatgatcaaactattctgagctaaaagagaaagttcgaacccatggcaaagaagttaaaaaccttgaaaaaaagttagatgaatagctaactagaatagccaatgcagagaagtccttaaaggacttgatggagctgaaaaccaaggcacgagaaatacatgatgaatgcacaagcctcagtaaccaattcgatcaactggaagaaagggtatcagtgatggaagatcaaatgaatgaaatgaagtgagaagagaagcttatagaaaaaagaataaaaagaaatgaacaaagccttcaagaaatatgggactatgtaaaaaccccaaatctacatcggattgttgtatccgaaagtgacagggagaatggaaccaagttggaaaacactctgcgggataatatccaggagaatttccccaatctagcaaggcaggccaacattcaaattcaggaaataacagagaatgctacaaagatactcctcgagaagagcaactccaagacacataattgtcagattcgccaaatttcaaatgaaggaaaaaatgttaaggatagccagagagaaaggtcgggttacccacaaagggaagcccatcggacaaacagcagatatgtcagtagaaactctacaagccggaagagagtgggggccaatattcaacattcttaaagaacagaattttcaacgcagaatttcatatacagtcaaactaagcttcataagtgaaggagaaataaaatgctttacagacaagcaaatgctgagagatttcgtcaccaccaggccttccctaaaagagctcctgaaggaagcactaaacatggaaaggaacaactgataccagccactgcaaaaacaggccaaattgtaaagaccattgaggctaggaagaaactgcatcacctaatgagcaaaatagccagctaacatcataatgacaggatcaaactcacacgtaacaatattaaccttaaatgcaaatgggctaaatgctccaattaaaagacacagactggcaaattggataaaaggtcaggagctatcagtatgctgtattcaggaaacacatctcacatacagagacacacataggcttaaaataaagggatggaggaagatctaccaagaaaatggaaaacataaaaaggcaggaattgcaatcctagtctctgataaaacagaatttaaaccaacaaagatcaaaagagacaaagaaggccattatataatggtaaagggatcaattcaacaagaagagctaactatcctaaatatatatgcacccaatacaggagcacccagattcataaagcaagtccttagagacctacaaagagacttagactcccacacagtaataatgggagactttaacaccccactgtcaacattagacagatcaacgagacagaaagttagcaaggatatccaggaactgaactcagctctgcaccaagtggacctaatagatatctacagaactctccaccccaaatcaacagaatataaattcttttcagcaccacaccacacttattccaaaattgaccacatagttggaagtaaagcactcttccgcaaatgtaaaaggacagaaattataacaaaatgtctctcagaccacagtgcaatcaaactagaacgcaggattaagaaactcactgaaaaccgctcaatgacatggaaactgaacaacctgctcctgagtgactactgggtacataacgaaatggaggcagaaataaagatgttctttgaaaccaaggagaacaaagacacaacataccagaatctctgggacgcattcaaagcagtgtgtagagggaaatttatagcactaaacgcccacaagagaaagtaggaaagatctaaaattgacaccctaacatcacaattaaaagaactagagaagcaagagcaaacacattcaaaatctagcagaaggcaagaacaactaagatcagagtagagctgaaggaaatagacacgcaaaaaacccttcaaaaaatcaatgaatccaggagctggtttttttaaaagatcaacaaaattgatagaccactagcaagactaataaagaagaaaagagagaggaatcaaatagactcaataaaaaatgataaaggggatatcaccaccgatcccatagaaatacaaactaccatcagagaatactataaacacctctacacaaataaactagacaatatagaagaaatggataaattcctcgacacatacacctcccaagactaaaccaggaagaagttgaatctttgaatagactaataacaggctctgaaattgaggcaataattaatagcttgccaagcaaaaaaagtcaaggaccacatggattcatagctgaattctaccagaggaaaaaggaggagctggtaccattccttctgaaactactccaatcaatagaaaaagagggagtcctccctaactcattttatgaggccagcatcatcctgttaccaaagcctggcagagacacaacaaaaaaaaagagaattttagaacaatatccctgatgaacattgatataaaaatcctcaataaatactggcaaaccgaatccagcagcacatcaaaaagcttatccaccatgatcaagtgggcttcatcccagggatgcaacgctggttcaacataggcaaatcaataaacgtaatccagcatataaacagaaccaatgacaaaaccatatgattatctcaatagatgcagaaaaagccttcgacaaaattcaacagcccttcatgctaaaaactctcaataaagtaggtattgatgggatgtacctcaaaataataagagctatctatgacaaacccacagccaatatcatattgaatgtgcgaaaactggaagcattccctttgaaaactggcacaagacagggatgtcctctctcaccactcctattcaacatagtgttggaagttctggccagggcaatcaggcaggagaaagaaagtgtattcaattaggaaaagaggaagtcaaattttccctgtttgccaatgagatgattgtatatctagaaaaccccattgtctcaacccaaaatctccttaagctgataggcaacttcagaaaagtctcaggatacaaaataaatgtgcaaaaatcagaagcattcttatacaccagtaacagacaaacggagagccaaatcatgagtgaactcccattcacaattgcttcaaagagaataaaatacctaggaatccaacttacaagggatatgaaggacttcttcaatgagaactacaaaccaatgctcaatgaaataaaagaggacacaaacaaatggaagaatattccatgctcatggataggaaaaatcaatatcgtgaaaatggccatactgcccaaggtaatttatagattcaatgccatccccatcaagctaccaatgactttcttcaaagaattggaaaaaactactttaaagttcatatggaaccaaaaaagagcccacatcgccaagtcaatcctaagccaaaagaacaaagctggaggcatcacgctacccgacttcaaactatactacaaggctacagtaaccaaaacagcatagtactggtatcaaaacagagatttagaccaatagaacagaacagagccctcagaaataatgctgcacatctacaaccatctgatctttgacaaacctgacaaaaacaagaaatggggaaaggattccctatttaataaatggtgcttgaaaaactggctagccatatgtagaaagctgaaatgagatcccttccttacactttatacaaaaattaactcaagatggattaaagacttacatgttagacctaaaaccataaaaacccaggaagaaaacctaagcaataccattcaggacataggcataggcgaggacttcatgtctaaaacaccaaaagcaatggaaacaaaagccaaaattgacaaataagatctaattaaactaaagagcttctgcacagcacaagaaactaccatcagagtgaacagacaaactacaaaatgggagaaaatttttacaatctactcatctgacaaagggctaatatccagaatcttcaatgaactcaaacaaatttacaagaaaaaaacaaacaaccccatcaacaagtgggcaaaggatatgaacagacgcttctcaaaagaagacatttatgcagccaaaacacacatgaaaaaacactcatcatcacttgccatcagagaaatgcaaatcaaaaccacaatgagataccatctcacaccagttagaatggcaatcattaaaaattcaggaaaccataggtgctggagaggatgtggagaaagacaaacacttttacactgttggtgggactgtaaaccagtccaacccttgtggaagtcagtgtggtgattcctcagggatgtagagctagaaataccatttgacccagccatcccattactgggtatatacctgaaggattataaatcatgctgctataaagacacttgcataggtatgtttattgcagcactattcacaatagcaaagacttgcaaccaagccaaatgtccaacaatgatagaccggattaagaaaacgtggcacatatacaccatggaatactatacagccataaaaaatgatgagttcatgtcctttgtagggacatggatgaagctggaagccatcattctcagcaaactatcgcaaggacaaaaaaccaaacactgtatgttctcactcataggtgggaattgaacaatgagaacagatggacacaggagggggagcatcacacaccggggcctgttgtggggtagggggaggggggagggatagcattaggagatatacctaatgttaaatgacgagttaatgggtgcagcacaccaacatggcacatgtatacatatgtaactaacctgcacattgtgcacatgtaccctaaaacttaaagtataataaaaaatagaaaaaagaaaaaccaaatatcttgtaataataaccagagctatctgtgaaaattctttctaatgtgtggattaatctagacgaatctaacctgttgattcaccatgttggaaacactctttttgtagagtttacaaaagggacatttctgagcccattgaggcctgtagtgaaaaaatgaatatccctcaataaaaactcgaaacaagctatttgtgaaaatactggttgatttcaagcattataatgggagagactcctcaccaaccccaggcagtcaaaggatagtcatctgggttaccccatgcattctaatgggagacattcctagccgaccccagccagtctaatgatagagacacctgcgtcactccaggcattctaatgagacagactcctggctgataccaggcattccaatggtgaagacacctgggcaacaccaggcattgttatgggagacactccaggttcactctagtcactctaaacagatagacttctagccaaattcaggcaatttaatgatagagacacctgggctaccccatgcattctaatgtaaggctgaccacaaggcagtctaataatagagacacatgggcagccccaggtcttctcattggagagactcccggatgactccaagtagtctaatgatagagacatctgggagacacaaggcattttaaaaggagagattccatgctgactccaggcattgggggtgacttctgagcaaccccaagcagtctaatgttggagacaccagagcgaccccaggcattcaatccagagagactccattgaccacaggcagtctaatgatagatacacttgggcaaacccacacattctaatgaaagaggttcttggtcaaccccaggcattctaatgatagagacatttgggacaccacaggcactctaatgggagagactcccagccaaccctaggcattctaatggtagagaattccatcttaccccaggcattctaatgggagaggcttccaactgacaccagacagtctaatgatagagtcattttggcgaacccagaccttccagtggaagagacttccggccaatttcaggcagtctaatgttacagacaacagggcaaccccaggcattctaatgagagagactacccaccaaaccaagtcagtctaaggagagagtcaccttggtgatgcaaggaacactaatgaaggagaatttaggccaatctctggcattataatgatagggaaacctgggtgatcccaggcattctagtgacagagaaaactgggctacctcagtcattctaataggagatatttccatctgacatcaggcattctaatggaagaaactcctggccaacccaggtagactaaagataacaacacctggtcgaccccaggcattctaatgggagagactcccagctgatcccaggcagtctaatgatagagacactttggagacctcagacattttaatgggagagactcctggtcaaaccccagcagtctaatgataaagacattttggtgaccccaggcattctaaggaaaaagactcccagcagatcccaggaattttaatggaagacttgaggtcgatcacaggcagtcttagaaagaagacacctgggagaccacaggtattctaatgggagagactcctggctgacccccagcagtctaattatagagacacctgggctaccccagacattctaacaaaagagattccttggcgaccccaggcaatgtgatgatacagacacctgaatgaccccaggcattctaatgggagatactcccagctgaacttagacagactaatgatagagacacctggccaaccacaggcattttattaggagagactcctggacgagcttaggcagcctaattgtagagacatgggggcaatctgaaacattgaaatggaaaagactcccggcggacccaaggcagtctagtgatagagacacctgggtgatcccatgcattctaatgggagagatttacagctgactgcagtcagtctaatgatggagacacctaggcaaccctaggcattctaatgggagagactcctggacaaccccaggcattctaatgatagagacacctcggcaaccccaggcgttgtaatgggcaaaactttcagccaaccccaggtattctcttgggagagactctttgctgacctcaagcagtctaattatagagacacctgcatgaccccaggcattctaatgttaaagactctcagacgatgccaggaattctaatgggagagactcttggcttacctcaagcagtctaaggtaaagacacctgagtgaccataaccattctaatgggaaagactcctggctgagcccagccagtttaattatagagacacttggtgtgaatcctaatgggagagattcccagctgaccccaggtggtgtaatgaaagagataactgggcaaccccaggcagtttaattatacagacacttggtgtgaatcctaatgggagagattcccagctgaccccaggtagtgtaatgaaagagatacctgggcaaccccaatcattctaatgagagagaccccttccaaacttaggttgtttaatgatagaggtgcatgagcaatattatcccaggtataataatgggaaattattatcccaggtataataatgggaaaacgtgccggctgacctcaggcagtctaatgatagagaaacctgggcaaacagaaattctaatagaaaagattgccagcagacctcagggattctaatgatagagacacctgattgaccacagagattataatgggagagactcccacccaatcccaggcagtctagtgatagagtcacctgggtgacccaggcattttcatgggagagacttctggccaattctaggcattctaatggtagagtcacctgggcaacaccagacattctaatggaagagagttctggccaaacagtctaattataaagaaacgtgggcaaccacaggcattcttgtgtgtgagattcctggttgaccccaggaagtctaatgatagagaaaccaggcatacttctgggaaagactttcacctcacacaaggcattgtaatgagagagcttcctggctgaccccaggaagtctaacgaaagagatatcttggtgatctcaggcattttaatggaagaaactcctggctgatgccaggaaggctaataagagagacacatgggtgactccaggcattcgaatgggagagactttcggctgaccccaggcattctaatgatagagacagctgagcaaccacaggctttctcccgtccaaccccaggcattctaattggacagacccctggcagacaccagacagtttaaggataaggacacttgggcaacagcaagcattctaactggagagactcctgggtgacccaaggcagtctaattatgaagacatctgaatgaccccaggcattctaatgggagagactcccagccaaccccaggctgtctagtgataaagacacctgggcgacctcatgcattgtaatgggaaagactactgactgaacccaagcagtctaacaatagagacacctgggagaccccaaacattctaatgcaagggatttttggtgcaacctaggcactctaacgggaaatgactggctgatgacaggtagtataatgatacagacacctgggtaaaaacaggcattcgaatgggagacacttctgaccgatcccaagtagtctaattatagagacacctgggcaatcccaggcattcgaacgggaaaggcacctggccaaccatgggcagtctaatagtagagacacctgagggacctgaggcattctaatgggagatacacctggccaaccatgggcagtctaataatagagacacctgggcaacctgaggcattctaatgggagaaactttcaccaaactcaggcaatctaatgatagagacagctgggctgcctcagggattctaatgggagagactcctggccgatcccaggcagtctaatgaaagagacaactgggcaaactcaggcattctaatgagagaaacctcacactgagcccagacagtctaactataaagacaccagggtgaccccaggcattctaatgtaagcgactccaagctgaccccaggcaagtctaatgatagagacacctgggcgaccccagacattctaatgggagagactcatggccaaccccaggcattctaatgaaagagactcctggttgacccaaggcaacctaataatagcgacaccaaatcgaccccacacattctaatgggagagacacccagccaaccacaggcagtctaatgatagagacacctgggcaaccacaggcatttgaatgggtgaaactccagaactaccccaggtattttaataatacagacacctggcattctaataagagagatttctagagaaccccaggcattctcttgaaagagtctcttggctgacccgaagcagtcaaattatagagacatctgggtgacacgggcattttaattggagaggctccatgccaactccaggtattctaataatagagaaatctgtgagatgccaggcattctaatgaaaaatacttttggcagaccccaggttttctaatgggagagactcccagctgaccccaggccttctaataatattgacatggggcaacactttgcattttattgggaaagactcctggctgaccacaggcattctaatgctaaagatacctaagcatccccaggcattataatgggagagactcccagcgattctaggcattgtaatgggagggactcctagctgactccagaagttgaatgatggagacacctgggcgaccaaaggcattctaatggcagggattttctgccgaccccaggcagtctaataatagagacacctgggtgatcaaaaacattttaatctgagagactcccggcagaccccaggcagtctagttggaaagactcctggccaaccccaggcagtccaatgataaagacaactgagctgccttaggcattttaatgggagaggctcccggctgacaccaggagtctaatgataaagacatctgggcaaaagtgggcattccaatgaaagagattcctggccgtccccaggcagtctaatgatagaaacacctacctggtcgactgaaagacatgtaatgggagaggctcaaggaagaccccaggctttctaattatagaggcaactagccaaccccaggcattctactggaagagactcctgagcaacacaggcattctaatgcaagagacttccagttgacaacacacattctaatgggagactattgggtgactgcaggcagtctaaaaatagagactacttggcaaccacaggtattctaatggaaaagactacttgctgactactggcagtctaattatagagacacctgtacgaccccaggcattcaaatgaaagagacatctgggggaccacaggcagtctaatcgtagagccacttgggcaatcccaggcattccaatgagaggcactcttagccaaacccaggcagtctaatgatggagacaactggctgaccccaggcattctattaagagagatttccagccgaacacaggaattctaatgatagagacacttgatcaaacacaggtattttaatgggagagactctcacccaactgcaggcagtctaatgataaaaacattttgttaagcctaggcattctaatgggagagatacttggctgaccccaggcactctaatgatagagaaaccagggccaccccagacattctaatgagagagacccctggcccaccccagcatgtctaatgaaagaaacacctgggtgatcccaggaattctaatgaaatagacgtgttataaaaactagaaaaaaagctaactgagaaaatgctttgtgatatgtagattcatatcacagagttaaacctctgttttgattcaacaggacacactagttttgtagaacctacaaatggacattttggaacctattgaggcctatagtaaaaaaacaaatatcttatgataaaaactacaaacaaactatctgtgaaaatggtttgagatgtgtagatttatctgacaaagttaaacttccttgttcatttaacattatggaaacactttttttgtagaatctacaaggttacatttctaaactcattaagacctatactgaaaaatggaatatcccatgacaaaaactagaaacaagcaatctgtgaaaattttttgccatgtgtggattcatctcacagagtagaacctctattttgattcaaaagattggtaatatactttttataaaatctataaagggatttctgagcccattgaggtgcatagtgaaaaacagagtatgccacgataaaaactaaaaacagcctctcagttaaaatgctttgagatgtgaggattcatctcacaggtttaaacctttgtttttattcaactgattggaaacactcaattttgtataattgagaagggacatcactgagcccatatagtgaaaaacctaatatcctgtgataaaaagaaggaaaaaaatctgggaatatgctttgtgatgtgtggatttatctcacagaatggaaactgtgttttgactcaccaagttagaaacactctttttgtaaaatctacaaagggacatttctgagcccattgaggactacagtaaaaaattgaacattgccctataaaaactagaaacaagctatctgtgaaaatgctttgtgatgtgtggattaacctcacagtgttaaacctctgttttgattcaacagatgggaaacacttttttatagaatctacaaagagacatttctgagcccattaaggcctgtaataaaaaaatcctgcgataaaaactagaaacaagttttatatgaaaatactttgctatttgtggattcatctcaccaaatcaaacctgtgttttgactcaaaaagttagaaacactctttttgtagaatctatgaagggacatttctgagcccaatgaggtctatagtgaaaacctgaatatcccacaataaaaacaagaaacaagctacctgtgaaaatactttccaatgtctggatttatctcacagaagtaaacctttcttttcaatcatcaggttggaaacaggatttttgtagaatctacaaaaaaccatttctgagcctgttgaggcctatagtaaaataacaaatattctgcaataaaaactagaaacaagctatctgtgatgtgatctgagctatttgtgatgtgtggattcatcttacagggttaaagctttgttttgattcaacaggttgaaaacacttttttgtagaatctacaaagggatgtatctgagcccattgaggactatattaaaaaattgaatatctcacgatataaactaaaaagaagctatctatgaaaatgcattgctaagtgtggattcatctcatagagataaaactttgttttgatataacagattggaaacacttattttgtagaatctacgaagtgacatttttgagcccattgaggcctatagtaataaactgaatatcctgtgataaaaaatagaaagaagcatctgttaacatgctttgcaacctgtggatacatctcacagagttaaacttttattttgattcaacagtttgaaacaggctttttgtagaatctacaaaggaacatttctgatgctatctaggcttatagcaaaaaaatgaatatcccttgataaaaactagaagcaaactatgtgaaaatgctttgtgatgtgttgattcatctcatagagttaaaccttggttttgattcaacagttagaaatacacttctttcagaatctatgaaggaacttttccgagccaattaagccctatagtaaaaaaccaaatattccacgataaatactagaaacgagctatcagagaagatgctcggtaatttgaggatttatattacagtgttaaatttttgtttgcattaagctggttggaaacactcttttagtaaaatctacagagggacatttctgcagttcttcaggcctatagtaagcagctgaatatcctgctctgaaaagtagaaacaggctatctgtgaaaatgctttgtgatatgtggactcttctcactgagtggcacctgagttgtgatacaccagactggaaacactctttttctagaacctataaagggacatgtctgaggccactgaagcctatagtgaaaaactgagtattccatgataaaaactagaaacaagccatctgtgaaaatgcattgtgttatttggattcacctcaccaaattaaagatgagttttgatttagtgtggaaaacactctttttgtagaatctatgaaaggatatttctgagcccattgaggatctatagtaaaaaaatctattatcctgtgataaacactagaagtaagctatctgtgaaaatgctttgccttgtgtggattcatcttacagaggtaagccattgttttaattcaacagattgaaaacgttctttttgtagaatctacaaaaagacatttctgagcttattcatgtttatagagaataaccaaatattttgtgataaaaactagaaactaggtatacgtgaaaatgctttgcaatgtgtggatttatctcacagagtgaaacctttattttcattcaagaggttggaaacactccttttgtagaatctagaaagggacatttctgagaccattgaggcctttagtgaaaaacaaaatatcccatgttaaaaacaagaaagaagctatctgtgaaaatgctttgtaatgtattaattcatttgactaaataaaacctgtgttttgattcactaggtttgaaacacttttatttacaatctatgaagaaacatttttgagccctttgaggtctatagtgaaaaagtgaatattctgtgacacaaactaaaaacaagctctctgtgaaaatgctttgcaatgtgtggatttatctcacagagttaaactttttttttattcaacaggttgaaaacactctatatagaatctacaaagagacatttctgagtctattgaggcctatagtgaaaattcaaatatttaaactaaaaacaagttatcaattaaaacgctttgtgatgtgtggattcatcacacagagttaaaccttggttttgattaagcaagttggaaacattcttttttagaatctagaagagacattactgagtgcatgaaggcctatagtgaagatctgaatatcccacgataaaaagtagaaacaagttatctgcgaatatgttttgtgatgtgtggatttatcccactgaatgaaacctgcgttttgattcaagttggatagactctttttgtaggatcaatgaagagtcatttctgagcccattgaggcttactgtgaaaactcgaatattgcactatagaaactagaaacaagctttctgtgaaaatactttgaaagctgtgaatttgtctcaccgaatcaaacctgtgttttggttcaacaagttggaaacactcttattgtagaatctacaaagggatatttatgagaccattgaggcctatagtgaaaaatgaaatatcccattataaaactagaaacaagctatctgagaaaatgctttttaacatctggatttgtctcactgagttaaagccttgttctaattcgttagactgaaatcacttttttgtaaaatctacaaaggaacatttctaagcttattgagggctatagtgaaaaaatgaatattccacgaaaagaactaggaacaagctatctgtgaaatgctttgcgatgcatggttttatctcacagagttaaatctttgttttgacttaacaggttggaaatcctttctttgtagaatctacaaagggatgtttccgagaccattgaggcctgtagtaaaaaatcaaatatctcatgatataaactaaaaagaatctatcaatgaaaatgcattgcaaggtgtagatttatctcatagagtaaaattttaattttgattcaacaggtggtaaacactcttttttttttttttttttttttttttttagaatctatgaagggacatcatttctgagcccattgagacttgtagtgaaaaaccaagcatcccctgataaataggtagtagaaacaaactacctatgaaaatgctttttgatttgtggatttatctcacagtgttaaatttttgatttgattcaactggttgaaaacattctttatgtagaatctatgaagagacgtttttgagcttatcgagatgtaaggtgagaaactgaatatcccgctatgcaaagtacaaacaagctctctgtgaaaatgctttgttatatggggattcttctcactgaatggatcttgtgttgtgattcactgggttggaaacacttttttttagaatctatgaagggacatttccgaggccatcgaggcctatagtgaacaacagaatattctgtgataaaaactagaaacaacctacctgtgaaaacgatttgtgatctttggattcatctcaccacatggaacctgtgttttgattcagctggttggaaaaactctttttgtggaatctaccaaaggatatttctaagcccgttgaggcctatattaaattgattatctcatggtaagaactagaaacaagctatctgtgaaaatgctttgcattaggtggattcatctcatgaagttaaacctttgttttattcaacaggttgaaagcattctttttgtagaatcta

SEQ ID NO: 842 - DNA, 4209 bp, Homo sapiens
acaatgccatccccatcaaatcctggttcagtgaccccagcgacacagcccttctcaacctgctcccaatgctggatgccctcaggtaagggaagtgggctctggacacttggatatctcaagaaaggaggaggtgggggatcctcagagggaataaaaaaggtttgtcctgttttaactctgttcccttaagaatttaacatttggacccaggtcgtcttacttcaaagctcatcactttagctagtaggctgtgggcaaattgaacctatctaatcatgaatatggtgataatttaggtcccacatctccagtgatgctgccttacaagagtgttgtgagggtatgaactataaggtactctaccaatgcaagttattgtcaccccaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaaaccatgcattataactttgaaaccaaagcggccttaggtccttctctggggttttgggaagtgaagagaggggactttgttcacatgcaccctgtcccacaggcagagggggaagagactgctgttggactcaaggggcagggggaaaggtggcgttgagtatagggatagaataatgcggacaccagatgcctgggatacaataatgctgacaccagatgctttggcgggaagggccgagtgacaggatgggcgcgctggtggggagtggaaggacaccttcggagaagcaggctatggaagcacgaaaggagaaaccggctatggaagcacgaaaggagaaacctggacggccaaagggcgtagagctggagaaaccgggcttcgtccggggcactgacgtggacaggttaagcgggcgctgcccccaggtggctggcgccccgacctccgctgtccgggaaggcgtcggtccccctcccagctgtcgcccagccggccccgcctccccggcgccctcccaagccggccctacttcgcgcacccgccacgtgacgctccgccctctttgagatcacatgatttaactcaagtcccgcagtgttcctccgcgctggcgtagtccctacctttccaacctcctctccagtccctattggtctactcattttggcacttaagcgttctgtagatctctccaaacatctgttttctttttgacttcttatttctggagatcatctccgccacttgggtactactttgttttggtgtcaacggccgccttcagcgtagcaacacggttcgtgaatagctaaccttgtaattgtccctgctgttcctctacgttgttaacgaaaggaacttggagaaccaagtctcgtatgatgattaccatcttttactcctcttcagccccagcttccttgaggggacggttggggaataggtttagagtaattttcgatgagcaaaagccaaccgtctttgctacgtcgcctgcgtagcccacaaattgattccaaagcgattacgctaatggcgtgagggggccggtcagttggtggtgctacgctagcagcgttagcgccgctgaggtagtggcgtatcttagcggggggggcagtccccgatagtcgggggcggggttggtgaatagggaagtggcgcaaattcgtggatcgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgaggacagtagccagggccgagggcgcgggacgcttacgctgacgccacagcctggccttggatcgggacaggcagcgcagggatcaggctgctggctgtggtggggttggcagcgagcctgaaactgctgtccttgggacccaggatgaaaggagtggggtagtggtggatgtggggttgagagggatgtggacaggagagagaaaccttagcatttgaggccttagagagtttgacagcctgagcttcaaatggtcatccccccagctagctaaggttgcgagattgaatcactagtcgacccaaacaagtcacctccgtctgattaagatagttgtttatggtgacgccctattgggggatggatcctggatatttaaatgagctccagtcagtgaggtcaggatctctgggactcagtgctgcaccgcgtgtacaaagacaaagagatgaatctggggtagatttaggtgctaggaatattgtttcttgagttcttgacaggtgcagcttcggggctgcattccttctgtctcctaattttcatctctttatcaggtgatagtagaaaaggctcccaaagctcggataggagacctggacaaaaagaaatacctggtgccttctgatctcacaggtgggaacctgatccaagactcaggcttgcttcctgtgggtgggagtgcagtctctgcgggaggaggctccacctagcagctgttcttttgagggcatttttgacctctgtgactttcttgcatcttgtatcttttgcagttggtcagttctacttcttgatccggaagcgaattcatctccgagctgaggatgccttgtttttctttgtcaacaatgtcattccacccaccagtgccacaatgggtcagctgtaccaggtatggtgactgggaagtggtggaggctttggagaggaatcttggaagagcgtgaggggaagaaagtgttgttacatcagtagttttggactagcttcctggcttgccttaaagtttcataatagccgtgggttgggggtttggacagaacagtaggagtagagagaaggaaagagaacagtgagctagagaaactatctgttcgggactcttcccagtccccctccccattccaaagcagcagaaaacagtttgaggcctttttgcccaggactgcagagattatactgctcgtgtggtaggccttggagtcagtgaaggagtcaggcaatggtttgtggttctagaagaacgtgtctgggtcgtggttggtttaagttactggagcccagttgctgaacagttttctgctttcatcccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccacc

SEQ ID NO: 843 - DNA, 1949 bp, Homo sapiens
aggaggtcgggcaggggaaagcctctcagaagctgagggccaggtggtgggggacagacaggagcgaggcttcagcacccaggagcacagctctccctgcatgacaggccaggtccccacccgggggctgggaggccagccatgaatgacctagcaccatccttgctcccggcgggctgggctggggctgcccgggcagtaggacattattgctatttcacagaagagtttccgttcgtcgggggcagtgccgggagctgccgggggggcaccacaactgtccgcaggatgggctcagttcaccacagccggtttgagcagcaccgagcccggcgggatgaccacccagccaggggccaacgcctctgggctgctggcagctgagttgacgcccgtggacaggtccagcacggtgcctggcagcagggggagtccatcggggcttggccgggagcagctgctctccgtcctttcaaggggcgtcttgtggccctccatgcccagggccctggtgggcaccgacccacgccccttctccccctcggccttgccaccagctgcgccagcaaggagggagaccacaggcaagcccagtccgccagccccaaagggcgagggcagcagcgggttcttggccagattgagaggcaggacggggcctggcagcccagggcccatgccccccccacccccactgcccccaccgttgccacaggccagggcactgaggtcaagggggccgggggccaggggtaggggtaagccgggcaggccagggcctccaaagagggcagctgggttggggatgatgatctgggccccactgacataggggccgccgtcgggggcgggcagtggcggcttggggggtgggcgcagctgcaggagctcttgctgctcgtgggacacaaagtggccatgggccttgatgtgcttgcgcagtgagctggggtccgtgtagcgcttgtggcagccgggcatcttgcagtagtagggcttgtccacatagtgggtgcgcgtgtgcttaaagcggtcactggagttggaatagcgcttgttgcagccctcgtaggggcagacgtagggcttctcacctgcagggtggtgcagtgcagtgccgccatgaggggtctctccccttcctgggtctcaccccatgcactcaacatttccccgggccaagcactccctgggaacatagatgccccaattctgggggcagggggcatccccagcacatggcatgagatctgcccccaggcagggcacagaggctgaaaactcagcctggttgactccagctctgcctagcctcgccctgcaccctctgctacagaggatgtgcctttcagcagcagaacatggccttggaggccgggcccggtggctcacgcctgtaatttcagcactttgggaggccaaggcaggcagatcacttgaggccaggagttccagaccagcagggccaacatggtgagaccccgtctctactaaaactacgaaaactagctgggtgtggtggcaggtgcctgtaatcccagctacctcagaggctgaggcaggagaatcacttgaacctgggaggcagaggttgcagtgggccaagatcatgccactgcactccagcctgggtgacagagtgagtctgtctcaagaaaaaaaagacaccatggccttggagatcacatcctggcacgaggcgcccagcgtgggcctggccacagggagtgctgcctgggcgctactgccctcactcaacaaatggctgaaggttcaccaggcatcttctgctgccctggccagagcagggggccacatgtagtgactgacctcctgatacatggctctccacctggagatgtgctgccagggtgaaataaacaccaggaaaaaacatacacatcagctccttgaggctttgtcatgaaatgaagaacttcaatatctca

SEQ ID NO: 844 - DNA, 5103 bp, Homo sapiens
tttcctttcagaagcactgctgacagtttggtggttgccattgggacagtgagccttttgttctttctgaggttgggctggtttctcctcttggccctgccctacagaccgtaaaggaaatcagcaagaagtccccagcaaacatccacagatggccctggacatcagccacattctgagaaacatgtcacgttctgggagggctaaggcatcaagtaaggcctatggggctggagaatccgagggcaggtggggcaacccagagccatgggggctacccatgggaattgggaggtcccaaggcagatgcaggggttccacaggagaagtcccagagccaccaagtgctctcctgtcccagggagcagtcaacaccatggactgaacacttactgggcttcaagctctgggccaggctggggcatgtggggccatgagggagctcagagtgggagacagagagacaagtgtgctcagagggcacccatttctgggtgtaatgtggtcctgagattttggctgagaagggtttccagggtttcatatgtgttatggagctgcttcctctccccagcctcaccttgcaggaatcccagtgaatatattgccaccctatttgagctcagtgccctcatagtgtaatggcaccagcagatctgcctgtgcatggacttcctgtactacccattcctgaggggtgatgcttctgcagggcctatgacctggtgcacaactttagacaccatcatcctggagcagcactgcaccctcactagccagggtgttcatgacttcctcaaggccaaggccacgttcaagacttgggacttcagtgatgcacttgtgctgggcaaggtggcttctccggtatcttaatttgccatggaaggtgctggataaaggagggacagtcagatatgtcttagagatgactgtagaaggctgcctggaaggagtgaacaagagccaggagacccaggagggagcttgtggggcaggtctggagatggcaagggagggatcctgcttggatgaaaagtcttcagggactgtctcaggttacactcaggtgccctcagagctaatgtgttcagaggtcttgtctccaggatgaaaatgggaaggagttgtcagaagaggacatataaatggaggctggcatcttcatgagtaccagcggtggtcccggtgtgggtctctccatccagggacatggtggatggacactacatcactccattctgcccttcctttccctcctcccattctcccaagggcctcagtgcatgggcggtgtccaacctctggtgctgaatcagccaagagatccaagcctgcttggctgcctcttaggatatgaaagcacagccactgggctctactgaatcctatgcaacctcagaagacacccaggagtgatgccatcacgtggtgcaagagttctgagggaccgcaatcctgaagacattgaatggtgggtgcagggcctcatggcctgttccacagctcctctcattggctctgctccaggtggtgaagggggataacatttctgtcaattctgccatgattgcctagcaggaaaaggagcagagcccagaagcagggcctggtatgcagcctgcctaacaagggagaatttataggctctgtggacggaaagatctgggagtccatatctatcacgcactagcttgctgagacattagtaaagtcagttttctgaactacatttctgtcatctgtaaattgagaggaatttcttctaccccacgaggcttcttggatagttagtgacagtgtgtgtagagcaggtgccatccagccggcatttggtgtccagaccactcctcttcccccttgattttctgcctaaatttgcattttgttcttaagattttcactccccttaattctgctcttccctctgatttctgccttactgtatatcccatggagtcaccaggatcaaagtgggtaaccgtcatgtatgcatgtatgtgtgtgtacatatacacattgctggggttggagtgtggtgtgtgggtaagtgtgagttggaatcactgactaaaactctccacaccaggctgtgttcctgctcattgctggaggcactgtcaggggccctgtcctcaaccccgggtctgacacttgcagatcaggcaggacattctggaggaatcatgcccttggaaggatccctgaggagtgactggtgggtattggtggataaataccccagctcccttgctttgggtgggatgactctgaggcacatgttctgtgctgtctctgcagatgtgcctggcagggctgagtcctggctgccacagaggaaactttcttgatgaaggtccctttaactgctgcattcctttcctgtctcagttccccactcctctactggtgtttcctgggattcgcaccctaaggaagaactggcagtcgaattactatcctagagttatctccaaatagaatttttgtatttgaatatgtgcctcaggatctacttccaggaaatttatactaaggcacacatttttctgtcagctccttcaatccccataggcctgccattgtgctgtttttatcgaaagggaatatgaggatcagagaggggaagtcacttgcccaaagtcacccagctgaacagtggtggagttcaactttgaccatgggaagtctggccccaaggtggatgcttgtttgtatcccatgagactcctcccttaccagggtcaaatgaatgaatggaggatgttaaaagtagagtctctgatgcctctgccagtgaaaccccaggctcatggctggcacctatgttctcactcttacctcattaggagtataatgaaaaacatgctcagtgctgaccgcgtgcctgggggtgttgtaggcactctgcttactttaattcatttaatttttacaataaccttgtttttacttctagttgttagattaaaaaacagtggcaaagagcaatacagagagttgccaaaattcacaccgctggtccaggtttgaagcaagcaatctgtacctgcagtccttgtctgtaaccatggcaccctggcttctcacacatctcatcgtggagttccaccatgtgtcaggcatggcactgagcaccttcttttaagaatataatttgtaattatgtagattcttaattctacttcaaaatgccacacagccttcatgtgataaaatgaaacaattggtgagtctaagcattgagaaaaaacgttcttttttccactcccgactccattccaacagttgggacagtgttttctctgtgcctgtagaaacctcagctcctgtgctgaggagcctgttccctttggggaatgtggcagtcaggtactggcagggacctcgaagtggctgaagggtcattaagaaaaagctgtttacgtaggtgtgggcagggccaaggggaaccaggggggatggcgcagggccctggggttagcgtcatctgggagctgtcaccaccctccaggctggtggggccatggagaagctgtttcagtaactcagagaatctgcagctgaaagaggaggccagaggagacatcactcactgtgccctttggctgcatctggatgccctcactgaccacactaccatccccttattagactggagaggctgcagggaggggttctaagcctcctatagtggctcacctccaacagtgagtcagcaccagcccccctagtcccacagcacagggtccacttagcccctgtatcctgcgtggtcccctttcctgctgggaagcagatatccaaatgaacagcagaatcctgtctctcccttcaggcccctctgctccttataagtggtgttttcccttggttttggatgagaaacaccctttcctcttccacagggattgtttctgtggaccccaccctgagttttcccctggttaggcaatgggcaggtggggatggtgggaccaactctttagaaccagcaatgacaaacagatcccacttgggggaagttgatgttaagtgtcatgggtcctctggaattttctgaagctttcctgttttttttttttctccccctaaccagctcaactgatctcctgggatctctactaagatgttggcagcccggtcagctggtctggccctggacgtgccttcagggtctggttatgcttcatgacctgcattgtggtcagtggtaagcagcacctgcttctagctttactgttgggtcagattttatccccactccagctctgcagtgtggctgcttcttgattcatccatggaccctgcacgaaattgccccatgttactgtttgtgcatcactgaggaaggaagcatgaaggacgcacaggtcaggccattccattgccctcctggtgctgggtttgccctcccaatcctggggttgcttcaggggctggtcgttctccatagccccctccacatttctcaggtttctgctcaaaagtcacctttcggaggggtctccacctgtcactgtgtttttaagagctccttcggtttctttctagctcatctcactctggtaatgtctttgattaccaccaccatctgacctggtcttatgatctgttagcttccttcatcagatgtgagcaccaggatggcaggggcctcatctgtcctgttcctcctgtggcctgggtcctagcaccatgtctggtacagtgtagatgctcaagggaagtttactttgtagaactgtttatctgggagatattactgttggtctaacctgtaccatattgtaaacctccagccattttgcagactttgatcacagtgaaacgttccatgggaacttgggccatgagaaacatccttcctaaccacgtgactgcagaaacatccttatcacatcctcctgggcaaaggcccaacagcctgactgcagggacatccttgccatatcctgctgggcagcaagctctaccacccagatccctccctcccagtcccatgattaccccagcctgtgagtggcagttggttctggcactaagctggtttcctcctccccagggttttgctggcaataaagatgttgctgttgaagccac

SEQ ID NO: 845 - DNA, 1880 bp, Homo sapiens
cttggctgcccccagccccgcccatgtctcagccccaagaccttctgggactttttttttttttagacaagagtttcgctcttctttcgctcttgttgcacaggctggagtgcagtggcgtgatctgggctcactgcaacctccaccttctgggttcaagcctcagcctcccgagtagccaccacgcccagctaatttttgtatttttaatagagacagggtttcaccatgttggccagtctggtctggaactcctaacctcaggtgatccgcccgccccagcttcccaaattgccgggattacaggtgtgaaccaccatggcagcccttctggcacttgccagcagcagcaagagcctcacgtgtcccccgcctcccctcagaccaagctccccaccgctgccgccacagagggtaccagggaggagaggctcaggacccccgtggcgaggatgcacctcccagccctcggcccagccacacggaccacagggctcccgagtctcagcaacaccagctaaggggcatcatgcctctcctgccacacccagggcccgtgccttgctgtccctgcagcccccagacccaggcagacagggacagcccttctgaccaccgcacacactcgccaccgcaaagatccccggggatgcccctcgcctgtgtgtgtccctcatggctgtcacagcaaatctccaggagcccggaggtgcccatggaaaacacccccagcttccggaacgttctttcggacagggccataccggagcaagactcagctttctggtagcgggtggctgggcactgcctgtgagattctgtcacactcgctccagattcaaggggtccaaaaagtgtaaacaagtcaagtgcccatccagggatgaacgaacacagcccggcccggccacaccatggagcaggactcggccatgaacaggaaccaggctctgacaccggccacggcgcagatgcccctggaggagtccaccctcagcaagagacacacagacaccgacacggcgtgcaatcccatttgtgtgaatgtccaggacaggccgattcagagacaggaaggggacacgtgggtgccagtgactggggattatggggactgggggaaatggctaaagggcacccacaaaagttaatgataatgttccacagttttttttttgagatggagtctcactcttgtcacccaggctggagtgcaatggtgtgatctctgctcactgcaagctctgcctcctgggttcacgccattctccctcctcagcctcccaagtagctgagattacaggcatatgccaccacccccagtagagacggggtttcaccatgttagccaggctggtcacgaactcctgacctcaagtgatcccccacctcggcctcccaaagtgctgggattacaggcatgagccaccgtgcctcaccagaattgtgtacttttttttcttcttcttcttcggcatggagtttcgctcttgttgcccaggctggagtgcaatggtgcaaacttggctcaccgcaacctcctcctcccgggttcaatagattctccagcctcagcctgctgagtagctgagattacgggcgcccgccaccacacccagctaatctttgtacttttagtagagacagggtttcaccatgttggccacgggcaaaagaattttgttgagggcaaataatatgagaccacaaaactgccttccctgctcagttttaattttcacagttttaatttttagccttctctggttaccaaaataaccacgctcacggccgttcatttgaagatatttccagttaacgtgtgtgaagtgggttttttgagatgtaatttacaagcaataaaatgctcctgtctctgc

SEQ ID NO: 846 - DNA, 5004 bp, Homo sapiens
tgtactcccagagccttgggaggtcgaggcgggaagatcgcttgagcccgggagctcgagaccagacgcggcaacatggcgagacgcacatctctgcctttaaaaatgtacatatatatatatatatatgaacgtattaataaattaggtgggaggaagtgacctcctccgcccaaataaaaatacttaaagggcacttgaatctggatctcagaaaatgaataatttcttagtataaacgtcctgtgcaccatttggttgggacaagtaagttcctcttcagaaactcaacttccaggtctaaagttgtcaatcaaccttacccccttcttctttcctcgcaggtggcgcgtttaccctattttaaaaaagttttaagttttagccaaccgggatcagcttagattgtgggcgtccaaccccagccaacagggaaaggacagaggaacagaagctcccttcctttgtcccgtgtgctctggagattgcatcccacgcaggcagcccccttccgtacaagtaaagtggtctcgctgagaaattttctaagtgctggtttctctttgcgggaccgactcgccgcccccaaatatcccatttggatcccattctgtttcaggagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacggtgagaaaagtcgctattggggcgacacaggtgggggcgtctcttggaggttgaaagtgtgtgttggaagttaaactcggagtcgcaatgcaagaggaccgcagactaagccgaacgcgaagggctaactggaaaggggcaggaatgtggctacactggcgggaagagcccgtggcgacgggagggggatgtgcagagtgggtggcaggtgccatctctgcagatcaggaccggcgggaaacttgtttactgagactcagacggggaggcccagagggtgaggaagtcaggttggccttggaagtaggaaacgaagaacgagggcgctgaacgagccaaacctttgaagaggaacttgtgaatgaatgagacgcgccatatcttttgtgtgtgtgtgtgttggagtctcgctgtgtcacccaggctggagtgcagcggcgcgatctcgactctctgcaacctccgcctcccgggttcaagcgattctcctgcctcagcctcctgagtagctgggattacaggcgcgcaccaccacgcccggctaatttttgtatttttagcagagacgccccatatctaaagaagggtgggatcctctagaccaccttcccccactcacccctccgcccctcccaacccaccccctccgcccctcccaacccaccccctccgcccctcccaacccaccccctccgcccctcccaacccaccccctccgcccctcccaacccacccctccgccccccccacccacccaccccacccctccgcccctccccaacccgcccctccgcccctcccacccacccctcgcccctccgcccctcccccacccgctcctccgcccctccatccctcccctatagaaccacctggaccttgccacccacatccccgctggacagccactagaacatgccccttcctcaggaaagctccaacgggaaacagaacaatgccaaagggatattcgaaactttcggccgggcgcggtggctcacgcctgtaattccagcactttgggaggcagaggcgggtggatcacgaggccaggagttcaggactggcagcctggccacgatgatgaaacctcgcctctactaaaaatacgaaaattagccggacgtggtggcgggcgcctgtaattccagctactcagctactcgggaggctgaggcagggaatgtcttgaacccgggaggtggagcttgcagtgagccgagatcgcgccaccgcactccagcctcggcaacaagagcgagactccgtctcaaaaaacaaacaaacaaacaaaaacccacagaactttccttttgcctcctgctcaaaaagacctgcctcagcccttttcccctttagggaaggaccaccgggaggaagggatattgacttcgtaaatgccccctttaaccagttcagaggttagaaatctaaaagaactcaaaccactgttagatgacccttttggattcgcggatcaaattgaccaatttctggggccacagctgtacgcttgggctgaattaatgtctaccctcagtactctcgtctcaggagagagagaaccatgattcacaggccgctgtgttagtctgggagcgtgaacaccccccggtcagaacgtcctttcagcggagcgtaaattcctggcccaagatcctgggtgggatgacaatgtgacctaaaaaacatgagcgatctcggagatgggataattacaaggattcgggaatcagatctgcaaacccaaaatacttcccgagcatttaacgtacaacagaggaaacatgaagggcccatggggttttttttggagacagagtctcgctctgtcgcccaggctggagttcagtggcgcgatctcagctcactccaacctccgcctcccgggttcaagcgattctcctgcctcagcctcccaagtagctgggattacaggcgcccgccaccacgcctggctaattttttgtattttagtggagacagggtttcaccatgttggccaagatggtctcgatctcctgaccttgtgatctgcccacgtcggcctcccaaagtgctgggattacaggcgtgagccaccgcgcctggccaggcccgtggaattcttaaacagacttaataaacagataagaaaatatgcagctgccggctcacgcctgtaatcccagcactttgggaggctgaggtgggcggatcatgaggtcaggagatccagaccatcctggctaacacggtgaaaccccatctctactaaaatacaaaaaaattagccgggcgtggtgggggcgcctgtagtcccagctactcgggagcctgaggcaggagaatggcctcaacccaggaggcggagcttgcagtgagccgagatcgcaccactgcgctccagcctgggcgacagagcgagactccgtctcaaaaaaaaaagaaagaaagaaaaaagaaaattggaaagaccatcccatagaggaactttttttttcttttttgagatggagtctcactcttttgcccaggctggagtgcagtggtgcgatctcggctcactgcaacctccacctgccaggttcaagcgattgtcctgcctcagcctcctgagtagctgggactacaggcacgcgccaccacgcctggctaatttttgtacttttagtagagacggggtttcaccttgttggccaggctggtcttgaactcctgacctcaagtgatccgcctgcctccacctcccaaagtgatgggattacaggcatgagccaccacgcccagccaagaaagagaacttttaactgctgggggcaaagaaataaaatacaaagaagaaattttacagctcctaggccgggcgtggtggctcaggcctgtaatcccagcactttgggaggctaaggcaggcggatcacctgaggtcaggagttggagaccagcctgaccaacatggagaaaccccatctctactaaaaatacagaattagccgggcgcggtggcaggtgcctataatcccagctactagggaggctgaggcaggagaatcgcttgaacctgggaggcggaggttgcggtgagccgagatcgtgccattgcactccagcctgggcaacaagagagaaactccatatgaaaaaaaaaaaaaaaaaaagaaattttacagctccaggatgccgtgtgggccccaaagacgtagctgttctgcgttgcagggtgcacaaaaggcaggaacactggaggccaaaggaaacaaaggcagacgaggaggcaaaacgggcagtaataaggacaccacattctaaagaggaagccctggctgtgcctctcctcccggagcctcccctcccagaggtcccacgttattctccaaacaaaaaagcttagtttgcccaagaaactggaaagtatattgaaagaagatcggccgggcgcagtgactcacgcctgtaatcccagcactttgggaggccgaggcaggcggatcacctgaggttgggagtttgagcagcctgaccaacatgaagaaaccctgtctctactaaaaatacaaaattagcggggcgtggtggtgtgcccctgtcatcccagctattcaggaggctgaggcaggagaatcgcttgaactcgggaggcggacgttgcagtgaccggagatcgcgccactgcactctagcctgggggacaagagtgatacttcgtctcaaaaaaaaaaaaaaagaaatagaatccaaccactttgggacccagatgggatgggcctagactgcgatcctgtccactcccactgctgttaatgtttcaggaactgtgccttcgatctccacagtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacg
